US009127276B2

(12) United States Patent
Prakash et al.

(10) Patent No.: US 9,127,276 B2
(45) Date of Patent: *Sep. 8, 2015

(54) CONJUGATED ANTISENSE COMPOUNDS AND THEIR USE

(71) Applicant: Isis Pharmaceuticals, Inc., Carlsbad, CA (US)

(72) Inventors: Thazha P. Prakash, Carlsbad, CA (US); Punit P. Seth, Carlsbad, CA (US); Eric E. Swayze, Encinitas, CA (US)

(73) Assignee: Isis Pharmaceuticals, Inc., Carlsbad, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/267,842

(22) Filed: May 1, 2014

(65) Prior Publication Data

US 2014/0343123 A1 Nov. 20, 2014

Related U.S. Application Data

(60) Provisional application No. 61/818,442, filed on May 1, 2013, provisional application No. 61/823,826, filed on May 15, 2013, provisional application No. 61/843,887, filed on Jul. 8, 2013, provisional application No. 61/871,673, filed on Aug. 29, 2013, provisional application No. 61/880,790, filed on Sep. 20, 2013, provisional application No. 61/976,991, filed on Apr. 8, 2014, provisional application No. 61/986,867, filed on Apr. 30, 2014.

(51) Int. Cl.
*C07H 21/02* (2006.01)
*C07H 21/04* (2006.01)
*C12N 15/13* (2006.01)
*C12N 15/113* (2010.01)
*C12N 15/11* (2006.01)

(52) U.S. Cl.
CPC .............. *C12N 15/113* (2013.01); *C07H 21/04* (2013.01); *C12N 15/111* (2013.01); *C12N 2310/11* (2013.01); *C12N 2310/113* (2013.01); *C12N 2310/315* (2013.01); *C12N 2310/321* (2013.01); *C12N 2310/322* (2013.01); *C12N 2310/3341* (2013.01); *C12N 2310/351* (2013.01); *C12N 2310/353* (2013.01); *C12N 2310/3511* (2013.01); *C12N 2310/3515* (2013.01); *C12N 2320/32* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,469,863 A | 9/1984 | Ts'o et al. |
| 4,751,219 A | 6/1988 | Kempen et al. |
| 4,845,205 A | 7/1989 | Huynh Dinh et al. |
| 5,023,243 A | 6/1991 | Tullis |
| 5,034,506 A | 7/1991 | Summerton et al. |
| 5,130,302 A | 7/1992 | Spielvogel et al. |
| 5,134,066 A | 7/1992 | Rogers et al. |
| 5,166,315 A | 11/1992 | Summerton et al. |
| 5,175,273 A | 12/1992 | Bischofberger et al. |
| 5,177,198 A | 1/1993 | Spielvogel et al. |
| 5,185,444 A | 2/1993 | Summerton et al. |
| 5,223,618 A | 6/1993 | Cook et al. |
| 5,256,775 A | 10/1993 | Froehler |
| 5,264,562 A | 11/1993 | Matteucci |
| 5,264,564 A | 11/1993 | Matteucci |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,432,272 A | 7/1995 | Benner |
| 5,434,257 A | 7/1995 | Matteucci et al. |
| 5,457,187 A | 10/1995 | Gmelner et al. |
| 5,459,255 A | 10/1995 | Cook et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,502,177 A | 3/1996 | Matteucci et al. |
| 5,508,270 A | 4/1996 | Baxter et al. |
| 5,525,711 A | 6/1996 | Hawkins et al. |
| 5,552,540 A | 9/1996 | Haralambidis |
| 5,587,469 A | 12/1996 | Cook et al. |
| 5,594,121 A | 1/1997 | Froehler et al. |
| 5,596,091 A | 1/1997 | Switzer |
| 5,602,240 A | 2/1997 | De Mesmaeker et al. |
| 5,610,289 A | 3/1997 | Cook et al. |
| 5,614,617 A | 3/1997 | Cook et al. |
| 5,625,050 A | 4/1997 | Beaton et al. |
| 5,645,985 A | 7/1997 | Froehler et al. |
| 5,681,941 A | 10/1997 | Cook et al. |
| 5,698,685 A | 12/1997 | Summerton et al. |

(Continued)

FOREIGN PATENT DOCUMENTS

| | | |
|---|---|---|
| WO | WO 94/02499 | 2/1994 |
| WO | WO 94/17093 | 8/1994 |

(Continued)

OTHER PUBLICATIONS

Abifadel et al., "Mutations in PCSK9 cause autosomal dominant hypercholesterolemia." Nat Genet. (2003) 34(2): 154-156.
Akinc et al., "Targeted Delivery of RNAi Therapeutics with Endogenous and Exogenous Ligand-Based Mechanisms" Molecular Therapy (2010) 18(7): 1357-1364.
Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.

(Continued)

Primary Examiner — Traviss C McIntosh, III
(74) Attorney, Agent, or Firm — Hoxie and Associates, LLC

(57) ABSTRACT

Provided herein are oligomeric compounds with conjugate groups. In certain embodiments, the oligomeric compounds are conjugated to N-Acetylgalactosamine.

6 Claims, No Drawings

(56) References Cited

U.S. PATENT DOCUMENTS

| | | |
|---|---|---|
| 5,750,692 A | 5/1998 | Cook et al. |
| 5,763,588 A | 6/1998 | Matteucci et al. |
| 5,830,653 A | 11/1998 | Froehler et al. |
| 5,994,517 A | 11/1999 | Ts'o et al. |
| 5,998,203 A | 12/1999 | Matulic-Adamic |
| 6,005,096 A | 12/1999 | Matteucci et al. |
| 6,268,490 B1 | 7/2001 | Imanishi et al. |
| 6,300,319 B1 | 10/2001 | Manoharan |
| 6,383,812 B1 | 5/2002 | Chen et al. |
| 6,525,031 B2 | 2/2003 | Manoharan |
| 6,525,191 B1 | 2/2003 | Ramasamy |
| 6,620,916 B1 | 9/2003 | Takahara et al. |
| 6,660,720 B2 | 12/2003 | Manoharan et al. |
| 6,670,461 B1 | 12/2003 | Wengel et al. |
| 6,727,064 B2 | 4/2004 | Karras |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 6,908,903 B1 | 6/2005 | Theodore et al. |
| 7,034,133 B2 | 4/2006 | Wengel et al. |
| 7,053,207 B2 | 5/2006 | Wengel |
| 7,259,150 B2 | 8/2007 | Crooke et al. |
| 7,262,177 B2 * | 8/2007 | Ts'O et al. .................. 514/50 |
| 7,399,845 B2 | 7/2008 | Seth et al. |
| 7,399,853 B2 | 7/2008 | Freier et al. |
| 7,425,544 B2 | 9/2008 | Dobie et al. |
| 7,427,672 B2 | 9/2008 | Imanishi et al. |
| 7,439,043 B2 | 10/2008 | DeFrees et al. |
| 7,491,805 B2 | 2/2009 | Vargeese et al. |
| 7,563,884 B2 | 7/2009 | Cowsert et al. |
| 7,569,686 B1 | 8/2009 | Bhat et al. |
| 7,582,744 B2 | 9/2009 | Manoharan et al. |
| 7,598,227 B2 | 10/2009 | Crooke et al. |
| 7,723,509 B2 | 5/2010 | Manoharan et al. |
| 7,741,457 B2 | 6/2010 | Swayze et al. |
| 7,750,142 B2 | 7/2010 | Freier |
| 7,851,615 B2 | 12/2010 | Manoharan et al. |
| 8,084,437 B2 | 12/2011 | Freier et al. |
| 8,093,222 B2 | 1/2012 | Freier et al. |
| 8,101,743 B2 | 1/2012 | Brown-Driver et al. |
| 8,106,022 B2 * | 1/2012 | Manoharan et al. .......... 514/43 |
| 8,137,695 B2 | 3/2012 | Rozema et al. |
| 8,143,230 B2 | 3/2012 | Bhanot et al. |
| 8,158,601 B2 | 4/2012 | Chen et al. |
| 8,313,772 B2 | 11/2012 | Rozema et al. |
| 8,344,125 B2 | 1/2013 | Manoharan et al. |
| 8,349,308 B2 | 1/2013 | Yurkovetskiy et al. |
| 8,404,862 B2 | 3/2013 | Manoharan et al. |
| 8,435,491 B2 | 5/2013 | Wang et al. |
| 8,450,467 B2 | 5/2013 | Manoharan et al. |
| 8,501,805 B2 | 8/2013 | Seth et al. |
| 8,501,930 B2 | 8/2013 | Rozema et al. |
| 8,530,640 B2 | 9/2013 | Seth et al. |
| 8,541,548 B2 | 9/2013 | Rozema |
| 8,546,556 B2 | 10/2013 | Seth et al. |
| 8,552,163 B2 | 10/2013 | Lee et al. |
| 8,664,190 B2 | 3/2014 | Freier et al. |
| 8,673,632 B2 | 3/2014 | Crooke et al. |
| 2003/0077829 A1 | 4/2003 | MacLachlan |
| 2003/0119724 A1 | 6/2003 | Ts'o et al. |
| 2003/0170249 A1 | 9/2003 | Hakomori et al. |
| 2004/0171570 A1 | 9/2004 | Allerson et al. |
| 2004/0242516 A1 | 12/2004 | Crooke et al. |
| 2005/0009088 A1 | 1/2005 | Crooke et al. |
| 2005/0130923 A1 | 6/2005 | Bhat et al. |
| 2005/0164235 A1 | 7/2005 | Manoharan et al. |
| 2005/0244869 A1 | 11/2005 | Brown-Driver et al. |
| 2006/0148740 A1 | 7/2006 | Platenburg |
| 2006/0183886 A1 | 8/2006 | Tso et al. |
| 2007/0287831 A1 | 12/2007 | Seth et al. |
| 2008/0039618 A1 | 2/2008 | Allerson et al. |
| 2008/0108801 A1 | 5/2008 | Manoharan et al. |
| 2008/0206869 A1 | 8/2008 | Smith et al. |
| 2008/0281041 A1 | 11/2008 | Rozema et al. |
| 2008/0281044 A1 | 11/2008 | Manoharan et al. |
| 2009/0012281 A1 | 1/2009 | Swayze et al. |
| 2009/0203132 A1 | 8/2009 | Swayze et al. |
| 2009/0203135 A1 | 8/2009 | Forst et al. |
| 2009/0286973 A1 | 11/2009 | Manoharan et al. |
| 2009/0306180 A1 | 12/2009 | Bhanot et al. |
| 2009/0326040 A1 | 12/2009 | Geary et al. |
| 2010/0240730 A1 | 9/2010 | Beigelman et al. |
| 2010/0331390 A1 | 12/2010 | Crooke et al. |
| 2011/0039910 A1 | 2/2011 | Crooke et al. |
| 2011/0077386 A1 | 3/2011 | Lee et al. |
| 2011/0097264 A1 | 4/2011 | Wang et al. |
| 2011/0097265 A1 | 4/2011 | Wang et al. |
| 2011/0123520 A1 | 5/2011 | Manoharan et al. |
| 2011/0201798 A1 | 8/2011 | Manoharan et al. |
| 2011/0207799 A1 | 8/2011 | Rozema et al. |
| 2011/0269814 A1 | 11/2011 | Manoharan et al. |
| 2012/0035115 A1 | 2/2012 | Manoharan et al. |
| 2012/0095075 A1 | 4/2012 | Manoharan et al. |
| 2012/0101148 A1 | 4/2012 | Aking et al. |
| 2012/0122958 A1 | 5/2012 | Dawson et al. |
| 2012/0128760 A1 | 5/2012 | Manoharan et al. |
| 2012/0136042 A1 | 5/2012 | Manoharan et al. |
| 2012/0157509 A1 | 6/2012 | Hadwiger et al. |
| 2012/0165393 A1 | 6/2012 | Rozema et al. |
| 2012/0183602 A1 | 7/2012 | Chen et al. |
| 2012/0225927 A1 | 9/2012 | Sah et al. |
| 2012/0230938 A1 | 9/2012 | Rozema et al. |
| 2013/0004427 A1 | 1/2013 | El-Sayed et al. |
| 2013/0035366 A1 | 2/2013 | Swayze et al. |
| 2013/0109817 A1 | 5/2013 | Yurkovetskiy et al. |
| 2013/0121954 A1 | 5/2013 | Wakefield et al. |
| 2013/0178512 A1 | 7/2013 | Manoharan et al. |
| 2013/0236968 A1 | 9/2013 | Manoharan et al. |
| 2013/0317085 A1 | 11/2013 | Crooke et al. |

FOREIGN PATENT DOCUMENTS

| | | |
|---|---|---|
| WO | WO 97/20563 | 6/1997 |
| WO | WO 97/46098 | 12/1997 |
| WO | WO 98/13381 | 4/1998 |
| WO | WO 99/14226 | 3/1999 |
| WO | WO 00/14048 | 3/2000 |
| WO | WO 01/53528 | 7/2001 |
| WO | WO 02/43771 | 6/2002 |
| WO | WO 02/092772 | 11/2002 |
| WO | WO 03/010284 | 2/2003 |
| WO | WO 2004/024757 | 3/2004 |
| WO | WO 2004/044181 | 5/2004 |
| WO | WO 2004/063208 | 7/2004 |
| WO | WO 2004/071407 | 8/2004 |
| WO | WO 2004/093783 | 11/2004 |
| WO | WO 2004/096016 | 11/2004 |
| WO | WO 2004/096996 | 11/2004 |
| WO | WO 2004/101619 | 11/2004 |
| WO | WO 2004/106356 | 12/2004 |
| WO | WO 2005/000201 | 1/2005 |
| WO | WO 2005/005599 | 1/2005 |
| WO | WO 2005/028628 | 1/2005 |
| WO | WO 2005/021570 | 3/2005 |
| WO | WO 2005/071080 | 8/2005 |
| WO | WO 2005/083124 | 9/2005 |
| WO | WO 2005/097155 | 10/2005 |
| WO | WO 2006/031461 | 3/2006 |
| WO | WO 2006/044531 | 4/2006 |
| WO | WO 2007/035759 | 3/2007 |
| WO | WO 2007/035771 | 3/2007 |
| WO | WO 2007/090071 | 8/2007 |
| WO | WO 2007/131237 | 11/2007 |
| WO | WO 2007/134014 | 11/2007 |
| WO | WO 2007/134181 | 11/2007 |
| WO | WO 2007/136988 | 11/2007 |
| WO | WO 2007/143317 | 12/2007 |
| WO | WO 2008/066776 | 6/2008 |
| WO | WO 2008/098788 | 8/2008 |
| WO | WO 2008/101157 | 8/2008 |
| WO | WO 2008/150729 | 12/2008 |
| WO | WO 2008/154401 | 12/2008 |
| WO | WO 2009/003009 | 12/2008 |
| WO | WO 2009/006478 | 1/2009 |

(56) References Cited

FOREIGN PATENT DOCUMENTS

| WO | WO 2009/046141 | 4/2009 |
|---|---|---|
| WO | WO 2009/061851 | 5/2009 |
| WO | WO 2009/073809 | 6/2009 |
| WO | WO 2009/082607 | 7/2009 |
| WO | WO 2009/126933 | 10/2009 |
| WO | WO 2009/134487 | 11/2009 |
| WO | WO 2009/143369 | 11/2009 |
| WO | WO 2009/148605 | 12/2009 |
| WO | WO 2010/017509 | 2/2010 |
| WO | WO 2010/036698 | 4/2010 |
| WO | WO 2010/045509 | 4/2010 |
| WO | WO 2010/048549 | 4/2010 |
| WO | WO 2010/048585 | 4/2010 |
| WO | WO 2010/054406 | 5/2010 |
| WO | WO 2010/077578 | 7/2010 |
| WO | WO 2010/083615 | 7/2010 |
| WO | WO 2010/088537 | 8/2010 |
| WO | WO 2010/101951 | 9/2010 |
| WO | WO 2010/103204 | 9/2010 |
| WO | WO 2010/121074 | 10/2010 |
| WO | WO 2010/129709 | 11/2010 |
| WO | WO 2010/144740 | 12/2010 |
| WO | WO 2010/148013 | 12/2010 |
| WO | WO 2011/005860 | 1/2011 |
| WO | WO 2011/005861 | 1/2011 |
| WO | WO 2011/038356 | 3/2011 |
| WO | WO 2011/047312 | 4/2011 |
| WO | WO 2011/100131 | 8/2011 |
| WO | WO 2011/115818 | 9/2011 |
| WO | WO 2011/120053 | 9/2011 |
| WO | WO 2011/133871 | 10/2011 |
| WO | WO 2011/139702 | 10/2011 |
| WO | WO 2011/139917 | 11/2011 |
| WO | WO 2011/163121 | 12/2011 |
| WO | WO 2012/037254 | 3/2012 |
| WO | WO 2012/068187 | 5/2012 |
| WO | WO 2012/083046 | 6/2012 |
| WO | WO 2012/083185 | 6/2012 |
| WO | WO 2012/089352 | 7/2012 |
| WO | WO 2012/089602 | 7/2012 |
| WO | WO 2012/135736 | 10/2012 |
| WO | WO 2012/142458 | 10/2012 |
| WO | WO 2012/145674 | 10/2012 |
| WO | WO 2012/145697 | 10/2012 |
| WO | WO 2012/149495 | 11/2012 |
| WO | WO 2012/174154 | 12/2012 |
| WO | WO 2012/177947 | 12/2012 |
| WO | WO 2013/033230 | 3/2013 |
| WO | WO 2013/043817 | 3/2013 |
| WO | WO 2013/075035 | 5/2013 |
| WO | WO 2013/119979 | 8/2013 |
| WO | WO 2013/142514 | 9/2013 |
| WO | WO 2013/165816 | 11/2013 |
| WO | WO 2013/166121 | 11/2013 |
| WO | WO 2013/173789 | 11/2013 |
| WO | WO 2013/177468 | 11/2013 |
| WO | WO 2014/076195 | 5/2014 |
| WO | WO 2014/076196 | 5/2014 |
| WO | WO 2014/118267 | 8/2014 |
| WO | WO 2014/118272 | 8/2014 |
| WO | WO 2014/179620 | 11/2014 |
| WO | WO 2014/179625 | 11/2014 |
| WO | WO 2014/179626 | 11/2014 |
| WO | WO 2014/179627 | 11/2014 |
| WO | WO 2014/179629 | 11/2014 |
| WO | WO 2014/207232 | 12/2014 |

OTHER PUBLICATIONS

Andre et al., "Determination of modulation of ligand properties of synthetic complex-type biantennary N-glycans by introduction of bisecting GlcNAc in silico, in vitro and in vivo" Eur. J. Biochem. (2004) 271: 118-134.

Atsma et al., "Partial characterization of low density lipoprotein preparations isolated from fresh and frozen plasma after radiolabeling by seven different methods." J Lipid Res. (1991) 32(1): 173-181.

Bergeron et al., "Subtilase-like pro-protein convertases: from molecular specificity to therapeutic applications." J Mol Endocrinol. (2000) 24(1): 1-22.

Biessen et al., "Novel hepatotrophic prodrugs of the antiviral nucleoside 9-(2-phosphonylmethoxyethyl)adenine with improved pharmacokinetics and antiviral activity" FASEB J. (2000) 14: 1784-1792.

Biessen et al., "Synthesis of Cluster Galactosides with High Affinity for the Hepatic Asialoglycoprotein Receptor" J. Med. Chem. (1995) 38:1538-1546.

Biessen et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852.

Braasch et al., "Locked nucleic acid (LNA): fine-tuning the recognition of DNA and RNA" Chem. Biol. (2001) 8:1-7.

Braasch et al., "Novel Antisense and Peptide Nucleic Acid Strategies for Controlling Gene Expression" Biochemistry (2002) 41(14): 4503-4510.

Branda et al., "Amplification of antibody production by phosphorothioate oligodeoxynucleotides" J Lab Clin Med. (1996) 128(3): 329-338.

Brubaker et al., "Structure-Function of the Glucagon Receptor Family of G Protein-Coupled Receptors: The Glucagon, GIP, GLP-1, and GLP-2 Receptors" Receptors and Channels (2002) 8: 179-188.

Chiang et al., "Antisense Oligonucleotides Inhibit Intercellular Adhesion Molecule 1 Expression by Two Distinct Mechanisms" J. Biol. Chem. (1991) 266:18162-18171.

Coltart et al., "Principles of Mucin Architecture: Structural Studies on Synthetic Glycopeptides Bearing Clustered Mono-, Di-, Tri-, and Hexasaccharide Glycodomains" J. Am. Chem. Soc. (2002) 124: 9833-9844.

Connolly et al., "Binding and Endocytosis of Cluster Glycosides by Rabbit Hepatocytes" J Biol Chem (1982) 257: 939-945.

Costa et al., "Amyloid fibril protein related to prealbumin in familial amyloidotic polyneuropathy" PNAS (1978) 75(9): 4499-4503.

Crew et al., "Eukaryotic initiation factor-4E in superficial and muscle invasive bladder cancer and its correlation with vascular endothelial growth factor expression and tumour progression" Br J Cancer (2000) 82(1): 161-166.

Crooke et al., "Pharmacokinetic Properties of Several Novel Oligonucleotide Analogs in mice" J. Pharmacol. Exp. Ther. (1996) 277(2):923-937.

Crooke et al., "Pharmacological Properties of 2'-O-Methoxyethyl Modified Oligonucleotides" in Antisense a Drug Technology, Chapter 10, pp. 273-303, Crooke, S.T., ed., 2008.

Crooke et al., "Toxicologic Properties of 2-O-Methoxyethyl Chimeric Antisense Inhibitors in Animals and Man" in Antisense a Drug Technology, Chapter 12, pp. 342-351, Crooke, S.T., ed., 2008.

Czech et al. "RNAi-based therapeutic strategies for metabolic disease" Nature Reviews Endocrinology (2011) 7: 473-484.

Davidson et al., "Apolipoprotein B: mRNA Editing, Lipoprotein Assembly, and Presecretory Degradation" Annu. Rev. Nutr. (2000) 20: 169-193.

De Benedetti et al., "Overexpression of eukaryotic protein synthesis initiation factor 4E in HeLa cells results in aberrant growth and morphology" PNAS (1990) 87: 8212-8216.

Dellinger et al., "Solid-Phase Chemical Synthesis of Phosphonoacetate and Thiophosphonoacetate Oligodeoxynucleotides" J. Am. Chem. Soc. (2003) 125: 940-950.

Dickson et al., "Rat Choroid Plexus Specializes in the Synthesis and the Secretion of Transthyretin" J Biol Chem (1986) 261(8): 3475-3478.

Dubuc et al., "Statins upregulate PCSK9, the gene encoding the proprotein convertase neural apoptosis-regulated convertase-1 implicated in familial hypercholesterolemia." Arterioscler Thromb Vasc Biol. (2004) 24(8): 1454-1459.

Duff et al., "Intrabody Tissue-Specific Delivery of Antisense Conjugates in Animals: Ligand-Linker-Antisense Oligomer Conjugates" Methods in Enzymology (1999) 313: 297-321.

(56) References Cited

OTHER PUBLICATIONS

Dupouy et al., "Watson—Crick Base-Pairing Properties of Nucleic Acid Analogues with Stereocontrolled a and b Torsion Angles (a,b-D-CNAs)" Angew. Chem. Int. Ed. (2006) 45: 3623-3627.

Elayadi et al., "Application of PNA and LNA oligomers to chemotherapy" Curr. Opinion Invens. Drugs (2001) 2:558-561.

Elchebly et al., "Increased Insulin Sensitivity and Obesity Resistance in Mice Lacking the Protein Tyrosine Phosphatase-1B Gene" Science (1999) 283: 1544-1548.

Encio et al., "The Genomic Structure of the Human Glucocorticoid Receptor" J Biol Chem (1991) 266(11): 7182-7188.

Englisch et al., "Chemically Modified Oligonucleotides as Probes and Inhibitors" Agnew Chem. Int. Ed. Engl. (1991) 30:613-629.

Freier et al., "The ups and downs of nucleic acid duplex stability: structure-stability studies on chemically-modified DNA:RNA duplexes" Nucleic Acids Research (1997) 25(22): 4429-4443.

Fried et al., "HBeAg and hepatitis B virus DNA as outcome predictors during therapy with peginterferon alfa-2a for HBeAg-positive chronic hepatitis B." Hepatology (2008) 47(2): 428-434.

Frieden et al., "Expanding the design horizon of antisense oligonucleotides with alpha-L-LNA" Nucleic Acids Research (2003) 31(21):6365-6372.

Fukada et al., "Two signals are necessary for cell proliferation induced by a cytokine receptor gp130: involvement of STAT3 in anti-apoptosis." Immunity (1996) 5(5): 449-460.

Ganem et al., "Hepatitis B Virus Infection—Natural History and Clinical Consequences" N Engl J Med. (2004) 350: 1118-1129.

Geary et al., "Pharmacokinetic Properties of 2'-O-(2-Methoxyethyl)-Modified Oligonucleotide Analogs in Rats" The Journal of Pharmacology and Experimental Therapeutics (2001) 296:890-897.

Geary et al.,"Effect of Dose and Plasma Concentration on Liver Uptake and Pharmacologic Activity of a 2'-Methoxyethyl Modified Chimeric Antisense Oligonucleotide Targeting PTEN." Biochem. Pharmacol. (2009) 78(3): 284-91.

Gehring et al., "Assignment of the human gene for the glucocorticoid receptor to chromosme 5" PNAS (1985) 82: 3751-3755.

Gensberg et al., "Subtilisin-related serine proteases in the mammalian constitutive secretory pathway." Semin Cell Dev Biol. (1998) 9(1): 11-17.

Giguere et al., "Functional Domains of the Human Glucocorticoid Receptor" Cell (1986) 46: 645-652.

Gough et al., "Mitochondrial STAT3 supports Ras-dependent oncogenic transformation." Science (2009) 324(5935): 1713-1716.

Graff et al., "Translational control and metastatic progression: Enhanced activity of the mRNA cap-binding protein eIF-4E selectively enhances translation of metastasis-related mRNAs" Clin. Exp. Metastasis (2003) 20: 265-273.

Hansen et al., "Glucagon Receptor mRNA Distribution in Rat Tissues" Peptides (1995) 16(6): 1163-1166.

Haydon et al., "Progression of eIF4E Gene Amplification and Overexpression in Benign and Malignant Tumors of the Head and Neck" Cancer (2000) 88(12): 2803-2810.

Hoffman et al., "'Brain-type' N-glycosylation of asialo-transferrin from human cerebrospinal fluid" FEBS Letters (1995) 359: 164-168.

Hollenberg et al., "Primary structure and expression of a functional human glucocorticoid receptor cDNA" Nature (1985) 318: 635-641.

Horn et al., "Chemical synthesis and characterization of branched oligodeoxyribonucleotides (bDNA) for use as signal amplifiers in nucleic acid quantification assays." Nucleic Acids Research (1997) 25: 4842-4849.

Horton et al., "Combined analysis of oligonucleotide microarray data from transgenic and knockout mice identifies direct SREBP target genes" PNAS (2003) 100(21): 12027-12032.

Jain et al., "Repression of Stat3 activity by activation of mitogen-activated protein kinase (MAPK)." Oncogene (1998) 17(24): 3157-3167.

Jayaprakash et al., "Non-Nucleoside Building Blocks for Copper-Assisted and Copper-Free Click Chemistry for the Efficient Synthesis of RNA Conjugates" Organic Letters (2010) 12(23): 5410-5413.

Jiang et al., "Glucagon and regulation of glucose metabolism" Am J Physiol Endocrinol Metab. (2003) 284: E671-E678.

Jiang et al., "The Design and Synthesis of Highly Branched and Spherically Symmetric Fluorinated Oils and Amphiles." Tetrahedron (2007) 63(19): 3982-3988.

Jin et al., "Use of α-N,N-bis[Carboxymethyl]lysine-Modified Peroxidase in Immunoassays" Analytical Biochemistry (1995) 229: 54-60.

Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327.

Kanasty et al., "Delivery Materials for siRNA Therapeutics" Nature Materials (2013) 12: 967-977.

Kassim et al., "Gene therapy for dyslipidemia: a review of gene replacement and gene inhibition strategies" Clinical Lipidology (2010) 5(6): 793-809.

Kato et al., "N-acetylgalactosamine incorporation into a peptide containing consecutive threonine residues by UDP-N-acetyl-D-galactosaminide:polypeptide N-acetylgalactosaminyltransferases" Glyobiology (2001) 11: 821-829.

Kerekatte et al., "The proto-oncogene/translation factor eIF4E: a survey of its expression in breast carcinomas." Int J Cancer (1995) 64: 27-31.

Khorev et al., "Trivalent, Gal/GalNAc-containing ligands designed for the asialoglycoprotein receptor" Bioorganic & Medicinal Chemistry (2008) 16: 5216-5231.

Kim et al., "Oligomeric Glycopeptidomimetics Bearing the Cancer Related TN-Antigen" Tetrahedron Letters (1997) 38(20): 3487-3490.

Kim et al., "Synthesis of Novel Phosphoramidite Building Blocks from Pentaerythritol" Synlett (2003) 12: 1838-1840.

Klaman et al., "Increased Energy Expenditure, Decreased Adiposity, and Tissue-Specific Insulin Sensitivity in Protein-Tyrosine Phosphatase 1B-Deficient Mice" Mol. Cell. Biol. (2000) 20(15): 5479-5489.

Koller et al., "Mechanisms of single-stranded phosphorothioate modified antisense oligonucleotide accumulation in hepatocytes." Nucleic Acids Res. (2011) 39(11): 4795-4807.

Kornilova et al., "Development of a fluorescence polarization binding assay for asialoglycoprotein receptor" Analytical Biochemistry (2012) 425: 43-46.

Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.

Kroschwitz, "Polynucleotides" Concise Encyclopedia of Polymer Science and Engineering (1990) John Wiley & Sons, NY pp. 858-859.

Kumar et al., "The first analogues of LNA (locked nucleic acids): phosphorothioate-LNA and 2'-thio-LNA" Bioorg Med Chem Lett. (1998) 8:2219-2222.

Lazaris-Karatzas et al., "Malignant transformation by a eukaryotic initiation factor subunit that binds to mRNA 5' cap" Nature (1990) 345: 544-547.

Lee et al., "Synthesis of some cluster glycosides suitable for attachment to proteins or solid matrices" Carbohydrate Research (1978) 67: 509-514.

Lee et al., "Facile Synthesis of a High-Affinity Ligand for Mammalian Hepatic Lectin Containing Three Terminal N-Acetylgalactosamine Residues" Bioconjugate Chem. (1997) 8: 762-765.

Lee et al., "New and more efficient multivalent glyco-ligands for asialoglycoprotein receptor of mammalian hepatocytes" Bioorganic & Medicinal Chemistry (2011) 19:2494-2500.

Lee et al., "Preparation of Cluster Glycosides of Nacetylgalactosamine That Have Subnanomolar Binding Constants Towards the Mammalian Hepatic Gal/GalNAc-specific Receptor" Glycoconjugate J. (1987) 4: 317-328.

Lee et al., "Synthesis of Peptide-Based Trivalent Scaffold for Preparation of Cluster Glycosides" Methods in Enzymology (2003) 362: 38-43.

(56) References Cited

OTHER PUBLICATIONS

Lee et al., "New synthetic cluster ligands for galactose/N-acetylgalactosamine-specific lectin of mammalian liver" Biochem (1984) 23: 4255-4261.

Lee et al., "Protein microarrays to study carbohydrate-recognition events" Bioorg Med Chem Lett (2006) 16(19): 5132-5135.

Lee et al., "Synthesis of multivalent neoglyconjugates of MUC1 by the conjugation of carbohydrate-centered, triazole-linked glycoclusters to MUC1 peptides using click chemistry." J Org Chem (2012) 77: 7564-7571.

Lee et al., "Antisense Technology: An Emerging Platform for Cardiovascular Disease Therapeutics" J of Cardiovasc Trans Res (2013) 6: 969-980.

Leren, "Mutations in the PCSK9 gene in Norwegian subjects with autosomal dominant hypercholesterolemia." Clin. Genet. (2004) 65(5): 419-422.

Liang et al., "Hepatitis B e Antigen—The Dangerous Endgame of Hepatitis B" N Engl J Med. (2002) 347: 208-210.

Letsinger et al., "Cholesteryl-conjugated oligonucleotides: Synthesis, properties, and activity as inhibitors of replication of human immunodeficiency virus in cell culture" PNAS (1989) 86:6553-6556.

Leumann et al., "DNA Analogues: From Supramolecular Principles to Biological Properties" Bioorganic & Medicinal Chemistry (2002) 10:841-854.

Link, "Pharmacological regulation of hepatic glucose production" Curr Opin Investig Drugs (2003) 4: 421-429.

Maier et al., "Synthesis of Antisense Oligonucleotides Conjugated to a Multivalent Carbohydrate Cluster for Cellular Targeting" Bioconjugate Chem. (2003) 14: 18-29.

Maierhofer et al., "Probing multivalent carbohydrate-lectin interactions by an enzyme-linked lectin assay employing covalently immobilized carbohydrates" Bioorganic & Medicinal Chemistry (2007) 15: 7661-7676.

Makino et al., "Intravenous Injection with Antisense Oligodeoxynucleotides Against Angiotensinogen Decreases Blood Pressure in Spontaneously Hypertensive RatS" Hypertension (1998) 31: 1166-1170.

Manoharan et al., "Chemical Modifications to Improve Uptake and Bioavailability of Antisense Oligonucleotides" Ann. N.Y. Acad. Sci. (1992) 660: 306-309.

Manoharan et al., "Cholic Acid-Oligonucleotide Conjugates for Antisense Applications" Bioorg. Med. Chem. Lett. (1994) 4:1053-1060.

Manoharan et al., "Introduction of a Lipophilic Thioether Tether in the Minor Groove of Nucleic Acids for Antisense Applications" Bioorg. Med. Chem. Lett. (1993) 3(12):2765-2770.

Manoharan et al., "Lipidic Nucleic Acids" Tetrahedron Lett. (1995) 36(21):3651-3654.

Manoharan et al., "N-(2-Cyanoethoxycarbonyloxy)succinimide: A New Reagent for Protection of Amino Groups in Oligonucleotides" J. Org. Chem. (1999) 64: 6468-6472.

Manoharan et al., "Oligonucleotide Conjugates: Alteration of the Pharmacokinetic Properties of Antisense Agents" Nucleosides & Nucleotides (1995) 14(3-5):969-973.

Manoharan, "Oligonucleotide Conjugates as Potential Antisense Drugs with Improved Uptake, Biodistribution, Targeted Delivery, and Mechanism of Action" Antisense & Nucleic Acid Drug Development (2002) 12: 103-128.

Marcaurelle et al., "Synthesis of Oxime-Linked Mucin Mimics Containing the Tumor-Related TN and Sialyl TN Antigens" Organic Letters (2001) 3(23): 3691-3694.

Maxwell et al., "Novel putative SREBP and LXR target genes identified by microarray analysis in liver of cholesterol-fed mice." J. Lipid Res. (2003) 44(11): 2109-2119.

Merwin et al., "Targeted delivery of DNA using YEE(GalNAcAH)3, a synthetic glycopeptide ligand for the asialoglycoprotein receptor." Bioconjug Chem (1994) 5(6): 612-620.

Mishra et al., "Improved leishmanicidal effect of phosphorotioate antisense oligonucleotides by LDL-mediated delivery" Biochim. Biophys. Acta (1995) 1264:229-237.

Miura et al., "Fluorometric determination of total mRNA with oligo(dT) immobilized on microtiter plates" Clin. Chem. (1996) 42:1758-1764.

Moucari et al., "Early serum HBsAg drop: a strong predictor of sustained virological response to pegylated interferon alfa-2a in HBeAg-negative patients." Hepatology (2009) 49(4): 1151-1157.

Neel et al., "Protein tyrosine phosphatases in signal transduction." Curr Opin Cell Biol. (1997) 9(2): 193-204.

Oberhauser et al., "Effective incorporation of 2'-O-methyl-oligoribonucleotides into liposomes and enhanced cell association through modifications with thiocholesterol" Nucl. Acids Res. (1992) 20(3):533-538.

Orum et al., "Locked nucleic acids: A promising molecular family for gene-function analysis and antisense drug development" Curr Opinion Mol Ther. (2001) 3: 239-243.

Palha, "Transthyretin as a Thyroid Hormone Carrier: Function Revisited" Clin Chem Lab Med (2002) 40(12): 1292-1300.

Park et al., "The asialoglycoprotein receptor clears glycoconjugates terminating with sialic acid a2,6GalNAc" PNAS (2005) 102(47): 17125-17129.

Pavia et al., "Synthetic TN glycopeptide related to human glycophorin AM. High-field proton and carbon-13 nuclear magnetic resonance study." Int J Pep Protein Res (1983) 22: 539-548.

Petrova et al., "Carrier-free cellular uptake and the gene-silencing activity of the lipophilic siRNAs is strongly affected by the length of the linker between siRNA and lipophilic group" Nucleic Acids Research (2012) 40(5): 2330-2344.

Pujol et al., "A Sulfur Tripod Glycoconjugate that Releases a High-Affinity Copper Chelator in Hepatocytes" Angew. Chem. Int. Ed. (2012) 51: 7445-7448.

Quesada et al., "Physiology of the pancreatic a-cell and glucagon secretion: role in glucose homeostasis and diabetes" J Endocrinol. (2008) 199: 5-19.

Rajur et al., "Covalent Protein-Oligonucleotide Conjugates for Efficient Delivery of Antisense Molecules" Bioconjugate Chem. (1997) 8: 935-940.

Raouane et al., "Synthesis, Characterization, and in Vivo Delivery of siRNA-Squalene Nanoparticles Targeting Fusion Oncogene in Papillary Thyroid Carcinoma" J. Med. Chem. (2011) 54: 4067-4076.

Rensen et al., "Design and Synthesis of Novel N-Acetylgalactosamine-Terminated Glycolipids for Targeting of Lipoproteins to the Hepatic Asialoglycoprotein Receptor" J. Med. Chem. (2004) 47:5798-5808.

Rensen et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584.

Rensen et al., "Stimulation of Liver-Directed Cholesterol Flux in Mice by Novel N-Acetylgalactosamine-Terminated Glycolipids With High Affinity for the Asialoglycoprotein Receptor" Arterioscler Thromb Vasc Biol (2006) 26: 169-175.

Rosenwald et al., "Upregulation of protein synthesis initiation factor eIF-4E is an early event during colon carcinogenesis" Oncogene (1999) 18: 2507-2517.

Rosenwald et al., "Growth factor-independent expression of the gene encoding eukaryotic translation initiation factor 4E in transformed cell lines" Cancer Lett. (1995) 98: 77-82.

Rossenberg et al., "Stable polyplexes based on arginine-containing oligopeptides for in vivo gene delivery" Gene Therapy (2004) 11: 457-464.

Rouchaud et al., "A New and Efficient Synthesis of Derivatives of Octahydro-4H-pyrrolo[1,2-c]pyrido[1',2'-a]imidazole" Eur. J. Org. Chem. (2011) 12: 2346-2353.

Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.

Sakaki et al., "Human Transthyretin (Prealbumin) Gene and Molecular Genetics of Familial Amyloidotic Polyneruopathy" Mol Biol Med. (1989) 6: 161-168.

Sanghvi, Chapter 15, Antisense Research and Applications, Crooke and Lebleu ed., CRC Press (1993).

(56) References Cited

OTHER PUBLICATIONS

Saraiva et al., "Amyloid Fibril Protein in Familial Amyloidotic Polyneuropathy, Portuguese Type" J Clin Invest. (1984) 74: 104-119.
Sato et al., "Glycoinsulins: Dendritic Sialyloligosaccharide-Displaying Insulins Showing a Prolonged Blood-Sugar-Lowering Activity" J. Am. Chem. Soc. (2004) 126: 14013-14022.
Seeger et al., "Hepatitis B virus biology" Microbiol Mol Biol Rev. (2000) 64(1): 51-68.
Seth et al., "Synthesis and biophysical characterization of R-6'-Me-α-L-LNA modified oligonucleotides." Bioorg. Med. Chem. (2011) 21(4): 1122-1125.
Seth et al., "Synthesis and Biophysical Evaluation of 2',4'-Constrained 2'O-Methoxyethyl and 2',4'-Constrained 2'O-Ethyl Nucleic Acid Analogues" J Org Chem. (2010) 75(5): 1569-1581.
Seth et al., "Design, Synthesis and Evaluation of Constrained Methoxyethyl (cMOE) and Constrained Ethyl (cEt) Nucleoside Analogs" Nucleic Acids Symposium Series (2008) 52(1): 553-554.
Shchepinov et al., "Oligonucleotide dendrimers: synthesis and use as polylabelled DNA probes." Nucleic Acids Research (1997) 25(22): 4447-4454.
Shchepinov et al., "Oligonucleotide dendrimers: stable nano-structures" Nucleic Acids Research (1999) 27(15): 3035-3041.
Shea et al., "Synthesis, hybridization properties and antiviral activity of lipid-oligodeoxynucleotide conjugates" Nucl. Acids Res. (1990) 18(13):3777-3783.
Shioji et al., "Genetic variants in PCSK9 affect the cholesterol level in Japanese." J. Hum. Genet. (2004) 49: 109-114.
Singh et al., "LNA (locked nucleic acids): synthesis and high-affinity nucleic acid recognition" Chem. Commun. (1998) 455-456.
Singh et al., "Synthesis of 2'-amino-LNA: A novel conformationally restricted high-affinity oligonucleotide analogue with a handle" J. Org. Chem. (1998) 63: 10035-10039.
Sliedregt et al., "Design and Synthesis of Novel Amphiphilic Dendritic Galactosides for Selective Targeting of Liposomes to the Hepatic Asialoglycoprotein Receptor" J. Med. Chem. (1999) 42:609-618.
Sofia et al., "Discovery of a beta-d-2'-deoxy-2'-alpha-fluoro-2'-beta-C-methyluridine Nucleotide Prodrug (PSA-7977) for the Treatment of Hepatitis C virus" J. Med. Chem. (2010) 53(19): 7202-7218.
Sousa et al., "Neurodegeneration in familial amyloid polyneuropathy: from pathology to molecular signaling" Prog Neurobiol (2003) 71: 385-400.
Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26):8362-8379.
Svinarchuk et al., "Inhibition of HIV proliferation in MT-4 cells by antisense oligonucleotide conjugated to lipophilic groups" Biochimie (1993) 75:49-54.
Tanskanen et al., "Senile systemic amyloidosis affects 25% of the very aged and associates with genetic variation in alpha2-macroglobulin and tau: A population-based autopsy study" Ann Med. (2008) 40(3): 232-239.
Taylor et al., "Curbing activation: proprotein convertases in homeostasis and pathology" FASEB J. (2003) 17: 1215-1227.
Timms et al., "A mutation in PCSK9 causing autosomal-dominant hypercholesterolemia in a Utah pedigree." Hum. Genet. (2004) 114(4): 349-353.
Tober et al., "Self-Metathesis of Polyol Allyl Ethers towards Carbohydrate-Based Oligohydroxy Derivatives" Eur. J. Org. Chem. (2013) 3: 566-577.
Tomiya et al., "Liver-targeting of primaquine-(poly-c-glutamic acid) and its degradation in rat hepatocytes" Bioorganic & Medicinal Chemistry (2013) 21: 5275-5281.
Toyokuni et al., "Synthetic vaccines: I. Synthesis of multivalent Tn antigen cluster-lysyllysine conjugates" Tetrahedron Lett (1990) 31(19): 2673-2676.
Valentijn et al., "Solid-phase Synthesis of Lysine-based Cluster Galactosides with High Affinity for the Asialoglycoprotein Receptor" Tetrahedron (1997) 53(2): 759-770.
Van Rossenberg et al., "Stable polyplexes based on arginine-containing oligopeptides for in vivo gene delivery" Gene Ther (2004) 11: 457-464.
Wahlestedt et al., "Potent and nontoxic antisense oligonucleotide containing locked nucleic acids" Proc. Natl. Acad. Sci. USA (2000) 97: 5633-5638.
Wang et al., "Expression of the Eukaryotic Translation Initiation Factors 4E and 2a in Non-Hodgkin's Lymphomas" Am. J. Pathol. (1999) 155(1): 247-255.
Weber et al., "Design and synthesis of P2-P1'-linked macrocyclic human renin inhibitors" J. Med. Chem. (1991) 34(9): 2692-2701.
Weinberger et al., "Identification of Human Glucocorticoid Receptor Complementary DNA Clones by Epitope Selection" Science (1985) 228: 740-742.
Westerlind et al., "Ligands of the asialoglycoprotein receptor for targeted gene delivery, part 1: Synthesis of and binding studies with biotinylated cluster glycosides containing N-acetylgalactosamine" Glycoconjugate Journal (2004) 21: 227-241.
Wu et al., "A New N-Acetylgalactosamine Containing Peptide as a Targeting Vehicle for Mammalian Hepatocytes Via Asialoglycoprotein Receptor Endocytosis" Current Drug Delivery (2004) 1: 119-127.
Yang et al., "STAT3 complements defects in an interferon-resistant cell line: Evidence for an essential role for STAT3 in interferon signaling and biological activities" PNAS (1998) 95: 5568-5572.
Zhong et al., "Stat3 and Stat4: Memers of the family of signal transducers and activators of transcription" PNAS (1994) 91: 4806-4810.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.
Zhou et al., "Proteolytic processing in the secretory pathway." J. Biol. Chem. (1999) 274(30): 20745-20748.
International Search Report for Application PCT/US12/52884 dated Nov. 20, 2012.
International Search Report for Application PCT/US14/36460 dated Oct. 10, 2014.
International Search Report for Application PCT/US14/36466 dated Dec. 1, 2014.
International Search Report for Application PCT/US14/36462 dated Dec. 23, 2014.
International Search Report for Application PCT/US14/56630 dated Dec. 24, 2014.
International Search Report for Application PCT/US14/43731 dated Dec. 10, 2014.
Asseline et al., "Modification of the 5' Terminus of Oligodeoxyribonucleotides for Conjugation with Ligands" in Current Protocols in Nucleic Acid Chemistry, 2001, Supplement 5, Chapter 4: Unit 4.9 (4.9.1-4.9.28); John Wiley & Sons.
Beaucage et al., "The functionalization of oligonucleotides via phosphoramidate derivatives" Tetrahedron (1993) 49(10): 1925-1963.
Kurosawa et al., "Selective silencing of a mutant transthyretin allele by small interfering RNAs" Biochemical and Biophysical Research Communications (2005) 337 (3): 1012-1018.
Machida et al., "Postmortem findings in a patient with cerebral amyloid angiopathy actively treated with corticosteroid" Amyloid (2012) 19: 47-49.
Zhao et al., "Synthesis and preliminary biochemical studies with 5'-deoxy-5'-methylidyne phosphonate linked thymidine oligonucleotides" Tetrahedron Letters (1996) 37(35): 6239-6242.
International Search Report for Application PCT/US14/36463 dated Dec. 30, 2014.

\* cited by examiner

CONJUGATED ANTISENSE COMPOUNDS AND THEIR USE

RELATED APPLICATIONS

This application claims priority under 35 USC 119(e) to U.S. Provisional Patent Application Nos. 61/818,442 filed on May 1, 2013; 61/823,826 filed May 15, 2013; 61/843,887 filed Jul. 8, 2013; 61/871,673 filed Aug. 29, 2013; 61/880,790 filed Sep. 20, 2013; 61/976,991 filed Apr. 8, 2014; 61/986,867 filed Apr. 30, 2014; each of which is incorporated herein in its entirety.

SEQUENCE LISTING

The present application is being filed along with a Sequence Listing in electronic format. The Sequence Listing is provided as a file entitled CORE0115USSEQ_ST25.txt, created on May 1, 2014, which is 692 Kb in size. The information in the electronic format of the sequence listing is incorporated herein by reference in its entirety.

BACKGROUND OF THE INVENTION

The principle behind antisense technology is that an antisense compound hybridizes to a target nucleic acid and modulates the amount, activity, and/or function of the target nucleic acid. For example in certain instances, antisense compounds result in altered transcription or translation of a target. Such modulation of expression can be achieved by, for example, target mRNA degradation or occupancy-based inhibition. An example of modulation of RNA target function by degradation is RNase H-based degradation of the target RNA upon hybridization with a DNA-like antisense compound. Another example of modulation of gene expression by target degradation is RNA interference (RNAi). RNAi refers to antisense-mediated gene silencing through a mechanism that utilizes the RNA-induced silencing complex (RISC). An additional example of modulation of RNA target function is by an occupancy-based mechanism such as is employed naturally by microRNA. MicroRNAs are small non-coding RNAs that regulate the expression of protein-coding RNAs. The binding of an antisense compound to a microRNA prevents that microRNA from binding to its messenger RNA targets, and thus interferes with the function of the microRNA. MicroRNA mimics can enhance native microRNA function. Certain antisense compounds alter splicing of pre-mRNA. Regardless of the specific mechanism, sequence-specificity makes antisense compounds attractive as tools for target validation and gene functionalization, as well as therapeutics to selectively modulate the expression of genes involved in the pathogenesis of diseases.

Antisense technology is an effective means for modulating the expression of one or more specific gene products and can therefore prove to be uniquely useful in a number of therapeutic, diagnostic, and research applications. Chemically modified nucleosides may be incorporated into antisense compounds to enhance one or more properties, such as nuclease resistance, pharmacokinetics or affinity for a target nucleic acid. In 1998, the antisense compound, Vitravene® (fomivirsen; developed by Isis Pharmaceuticals Inc., Carlsbad, Calif.) was the first antisense drug to achieve marketing clearance from the U.S. Food and Drug Administration (FDA), and is currently a treatment of cytomegalovirus (CMV)-induced retinitis in AIDS patients. For another example, an antisense oligonucleotide targeting ApoB, KYNAMRO™, has been approved by the U.S. Food and Drug Administration (FDA) as an adjunct treatment to lipid-lowering medications and diet to reduce low density lipoprotein-cholesterol (LDL-C), ApoB, total cholesterol (TC), and non-high density lipoprotein-cholesterol (non HDL-C) in patients with homozygous familial hypercholesterolemia (HoFH).

New chemical modifications have improved the potency and efficacy of antisense compounds, uncovering the potential for oral delivery as well as enhancing subcutaneous administration, decreasing potential for side effects, and leading to improvements in patient convenience. Chemical modifications increasing potency of antisense compounds allow administration of lower doses, which reduces the potential for toxicity, as well as decreasing overall cost of therapy. Modifications increasing the resistance to degradation result in slower clearance from the body, allowing for less frequent dosing. Different types of chemical modifications can be combined in one compound to further optimize the compound's efficacy.

SUMMARY OF THE INVENTION

In certain embodiments, the present disclosure provides conjugated antisense compounds. In certain embodiments, the present disclosure provides conjugated antisense compounds comprising an antisense oligonucleotide complementary to a nucleic acid transcript. In certain embodiments, the present disclosure provides methods comprising contacting a cell with a conjugated antisense compound comprising an antisense oligonucleotide complementary to a nucleic acid transcript. In certain embodiments, the present disclosure provides methods comprising contacting a cell with a conjugated antisense compound comprising an antisense oligonucleotide and reducing the amount or activity of a nucleic acid transcript in a cell.

The asialoglycoprotein receptor (ASGP-R) has been described previously. See e.g., Park et al., PNAS vol. 102, No. 47, pp 17125-17129 (2005). Such receptors are expressed on liver cells, particularly hepatocytes. Further, it has been shown that compounds comprising clusters of three N-acetyl-galactosamine (GalNAc) ligands are capable of binding to the ASGP-R, resulting in uptake of the compound into the cell. See e.g., Khorev et al., Bioorganic and Medicinal Chemistry, 16, 9, pp 5216-5231 (May 2008). Accordingly, conjugates comprising such GalNAc clusters have been used to facilitate uptake of certain compounds into liver cells, specifically hepatocytes. For example it has been shown that certain GalNAc-containing conjugates increase activity of duplex siRNA compounds in liver cells in vivo. In such instances, the GalNAc-containing conjugate is typically attached to the sense strand of the siRNA duplex. Since the sense strand is discarded before the antisense strand ultimately hybridizes with the target nucleic acid, there is little concern that the conjugate will interfere with activity. Typically, the conjugate is attached to the 3' end of the sense strand of the siRNA. See e.g., U.S. Pat. No. 8,106,022. Certain conjugate groups described herein are more active and/or easier to synthesize than conjugate groups previously described.

In certain embodiments of the present invention, conjugates are attached to single-stranded antisense compounds, including, but not limited to RNase H based antisense compounds and antisense compounds that alter splicing of a pre-mRNA target nucleic acid. In such embodiments, the conjugate should remain attached to the antisense compound long enough to provide benefit (improved uptake into cells) but then should either be cleaved, or otherwise not interfere with the subsequent steps necessary for activity, such as hybridization to a target nucleic acid and interaction with RNase H or enzymes associated with splicing or splice modulation. This balance of properties is more important in the setting of single-stranded antisense compounds than in siRNA compounds, where the conjugate may simply be attached to the sense strand. Disclosed herein are conjugated single-stranded antisense compounds having improved potency in liver cells in vivo compared with the same antisense compound lacking the conjugate. Given the required balance of properties for these compounds such improved potency is surprising.

In certain embodiments, conjugate groups herein comprise a cleavable moiety. As noted, without wishing to be bound by mechanism, it is logical that the conjugate should remain on the compound long enough to provide enhancement in uptake, but after that, it is desirable for some portion or, ideally, all of the conjugate to be cleaved, releasing the parent compound (e.g., antisense compound) in its most active form. In certain embodiments, the cleavable moiety is a cleavable nucleoside. Such embodiments take advantage of endogenous nucleases in the cell by attaching the rest of the conjugate (the cluster) to the antisense oligonucleotide through a nucleoside via one or more cleavable bonds, such as those of a phosphodiester linkage. In certain embodiments, the cluster is bound to the cleavable nucleoside through a phosphodiester linkage. In certain embodiments, the cleavable nucleoside is attached to the antisense oligonucleotide (antisense compound) by a phosphodiester linkage. In certain embodiments, the conjugate group may comprise two or three cleavable nucleosides. In such embodiments, such cleavable nucleosides are linked to one another, to the antisense compound and/or to the cluster via cleavable bonds (such as those of a phosphodiester linkage). Certain conjugates herein do not comprise a cleavable nucleoside and instead comprise a cleavable bond. It is shown that that sufficient cleavage of the conjugate from the oligonucleotide is provided by at least one bond that is vulnerable to cleavage in the cell (a cleavable bond).

In certain embodiments, conjugated antisense compounds are prodrugs. Such prodrugs are administered to an animal and are ultimately metabolized to a more active form. For example, conjugated antisense compounds are cleaved to remove all or part of the conjugate resulting in the active (or more active) form of the antisense compound lacking all or some of the conjugate.

In certain embodiments, conjugates are attached at the 5' end of an oligonucleotide. Certain such 5'-conjugates are cleaved more efficiently than counterparts having a similar conjugate group attached at the 3' end. In certain embodiments, improved activity may correlate with improved cleavage. In certain embodiments, oligonucleotides comprising a conjugate at the 5' end have greater efficacy than oligonucleotides comprising a conjugate at the 3' end (see, for example, Examples 56, 81, 83, and 84). Further, 5'-attachment allows simpler oligonucleotide synthesis. Typically, oligonucleotides are synthesized on a solid support in the 3' to 5' direction. To make a 3'-conjugated oligonucleotide, typically one attaches a pre-conjugated 3' nucleoside to the solid support and then builds the oligonucleotide as usual. However, attaching that conjugated nucleoside to the solid support adds complication to the synthesis. Further, using that approach, the conjugate is then present throughout the synthesis of the oligonucleotide and can become degraded during subsequent steps or may limit the sorts of reactions and reagents that can be used. Using the structures and techniques described herein for 5'-conjugated oligonucleotides, one can synthesize the oligonucleotide using standard automated techniques and introduce the conjugate with the final (5'-most) nucleoside or after the oligonucleotide has been cleaved from the solid support.

In view of the art and the present disclosure, one of ordinary skill can easily make any of the conjugates and conjugated oligonucleotides herein. Moreover, synthesis of certain such conjugates and conjugated oligonucleotides disclosed herein is easier and/or requires few steps, and is therefore less expensive than that of conjugates previously disclosed, providing advantages in manufacturing. For example, the synthesis of certain conjugate groups consists of fewer synthetic steps, resulting in increased yield, relative to conjugate groups previously described. Conjugate groups such as GalNAc3-10 in Example 46 and GalNAc3-7 in Example 48 are much simpler than previously described conjugates such as those described in U.S. Pat. No. 8,106,022 or U.S. Pat. No. 7,262,177 that require assembly of more chemical intermediates. Accordingly, these and other conjugates described herein have advantages over previously described compounds for use with any oligonucleotide, including single-stranded oligonucleotides and either strand of double-stranded oligonucleotides (e.g., siRNA).

Similarly, disclosed herein are conjugate groups having only one or two GalNAc ligands. As shown, such conjugates groups improve activity of antisense compounds. Such compounds are much easier to prepare than conjugates comprising three GalNAc ligands. Conjugate groups comprising one or two GalNAc ligands may be attached to any antisense compounds, including single-stranded oligonucleotides and either strand of double-stranded oligonucleotides (e.g., siRNA).

In certain embodiments, the conjugates herein do not substantially alter certain measures of tolerability. For example, it is shown herein that conjugated antisense compounds are not more immunogenic than unconjugated parent compounds. Since potency is improved, embodiments in which tolerability remains the same (or indeed even if tolerability worsens only slightly compared to the gains in potency) have improved properties for therapy.

In certain embodiments, conjugation allows one to alter antisense compounds in ways that have less attractive consequences in the absence of conjugation. For example, in certain embodiments, replacing one or more phosphorothioate linkages of a fully phosphorothioate antisense compound with phosphodiester linkages results in improvement in some measures of tolerability. For example, in certain instances, such antisense compounds having one or more phosphodiester are less immunogenic than the same compound in which each linkage is a phosphorothioate. However, in certain instances, as shown in Example 26, that same replacement of one or more phosphorothioate linkages with phosphodiester linkages also results in reduced cellular uptake and/or loss in potency. In certain embodiments, conjugated antisense compounds described herein tolerate such change in linkages with little or no loss in uptake and potency when compared to the conjugated full-phosphorothioate counterpart. In fact, in certain embodiments, for example, in Examples 44, 57, 59, and 86, oligonucleotides comprising a conjugate and at least one phosphodiester internucleoside linkage actually exhibit increased potency in vivo even relative to a full phosphorothioate counterpart also comprising the same conjugate. Moreover, since conjugation results in substantial increases in uptake/potency a small loss in that substantial gain may be acceptable to achieve improved tolerability. Accordingly, in certain embodiments, conjugated antisense compounds comprise at least one phosphodiester linkage.

In certain embodiments, conjugation of antisense compounds herein results in increased delivery, uptake and activity in hepatocytes. Thus, more compound is delivered to liver tissue. However, in certain embodiments, that increased delivery alone does not explain the entire increase in activity. In certain such embodiments, more compound enters hepatocytes. In certain embodiments, even that increased hepatocyte uptake does not explain the entire increase in activity. In such embodiments, productive uptake of the conjugated compound is increased. For example, as shown in Example 102, certain embodiments of GalNAc-containing conjugates increase enrichment of antisense oligonucleotides in hepatocytes versus non-parenchymal cells. This enrichment is beneficial for oligonucleotides that target genes that are expressed in hepatocytes.

In certain embodiments, conjugated antisense compounds herein result in reduced kidney exposure. For example, as shown in Example 20, the concentrations of antisense oligonucleotides comprising certain embodiments of GalNAc-containing conjugates are lower in the kidney than that of antisense oligonucleotides lacking a GalNAc-containing conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly for non-kidney targets, kidney accumulation is undesired.

In certain embodiments, the present disclosure provides conjugated antisense compounds represented by the formula:

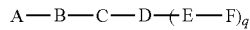

wherein
A is the antisense oligonucleotide;
B is the cleavable moiety
C is the conjugate linker
D is the branching group
each E is a tether;
each F is a ligand; and
q is an integer between 1 and 5.

In the above diagram and in similar diagrams herein, the branching group "D" branches as many times as is necessary to accommodate the number of (E-F) groups as indicated by "q". Thus, where q=1, the formula is:

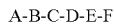

where q=2, the formula is:

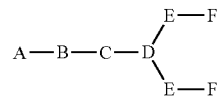

where q=3, the formula is:

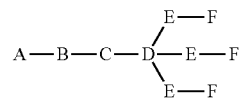

where q=4, the formula is:

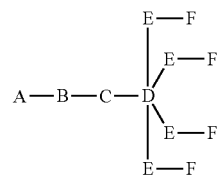

where q=5, the formula is:

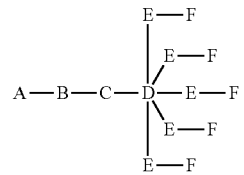

In certain embodiments, conjugated antisense compounds are provided having the structure:

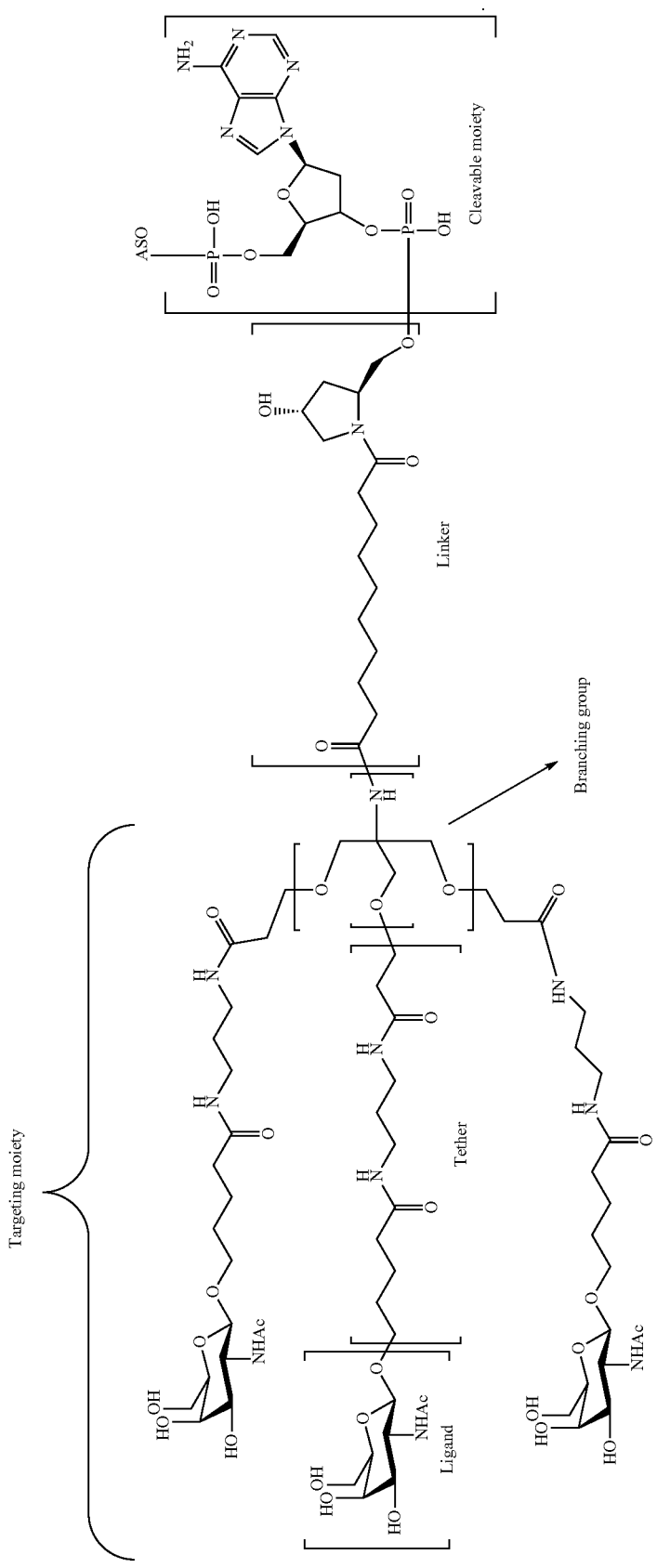

In certain embodiments, conjugated antisense compounds are provided having the structure:
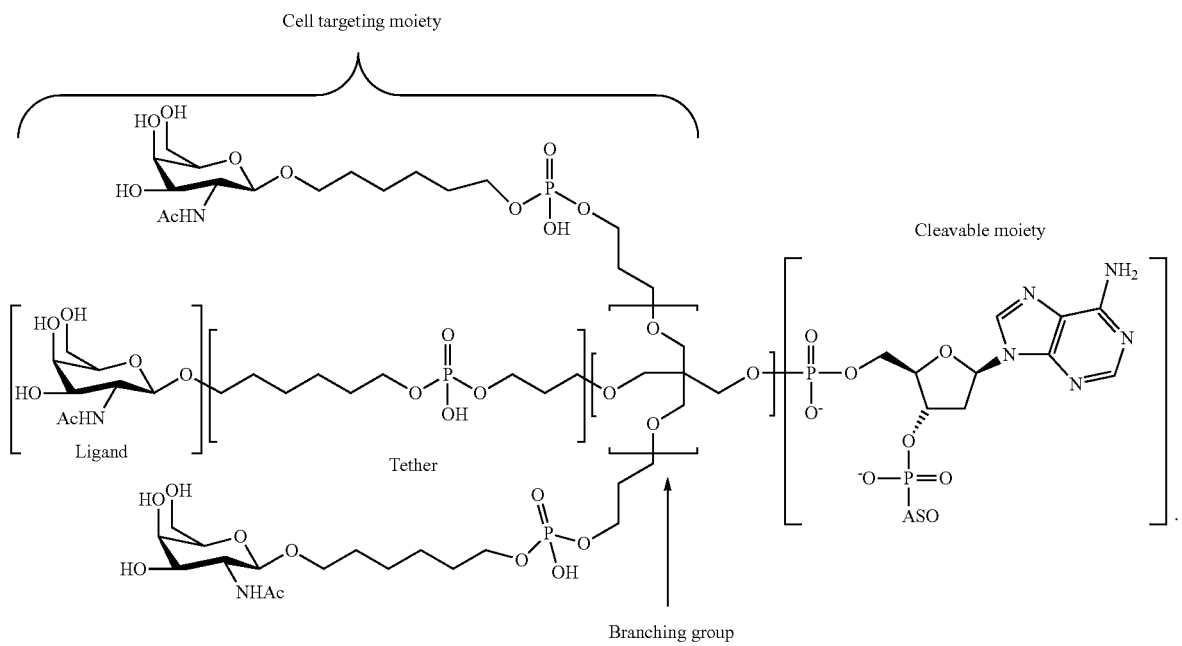
In certain embodiments, conjugated antisense compounds are provided having the structure:
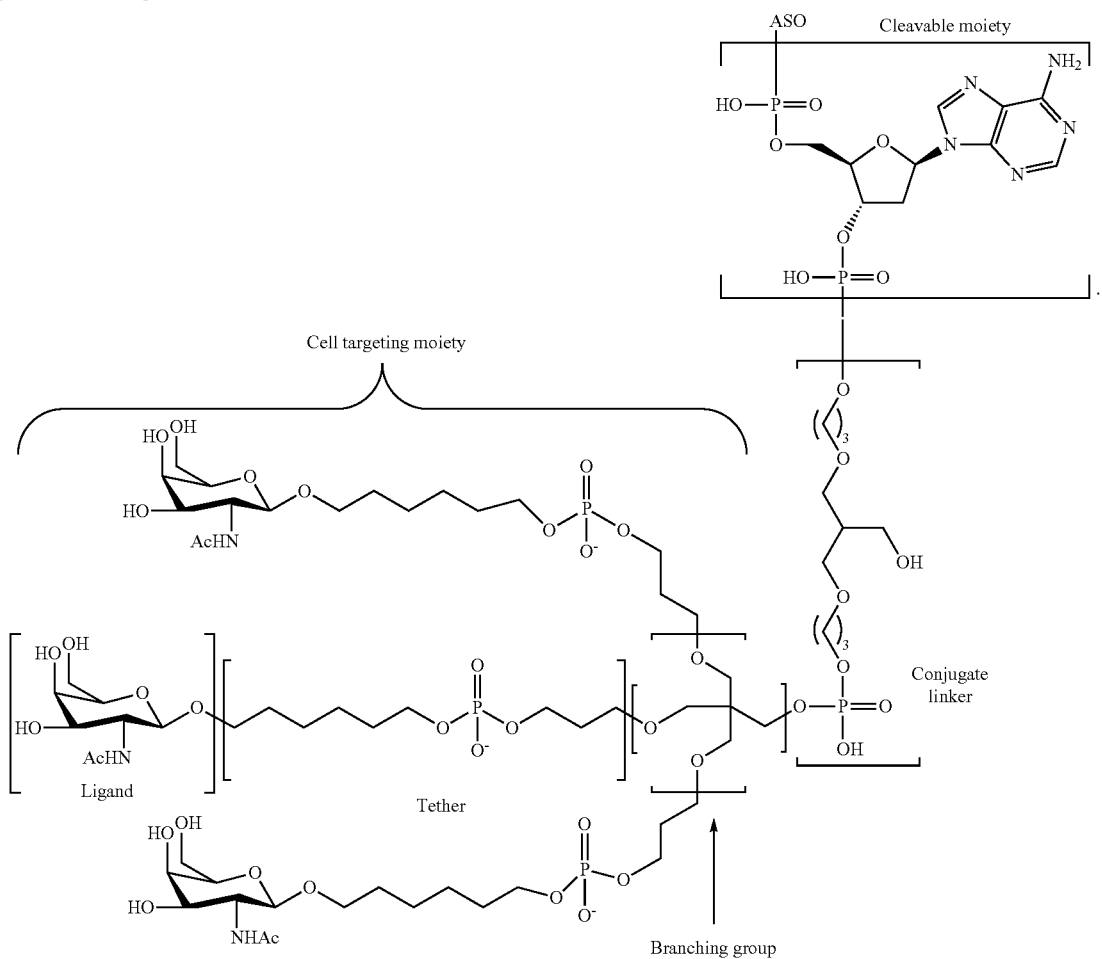

In certain embodiments, conjugated antisense compounds are provided having the structure:

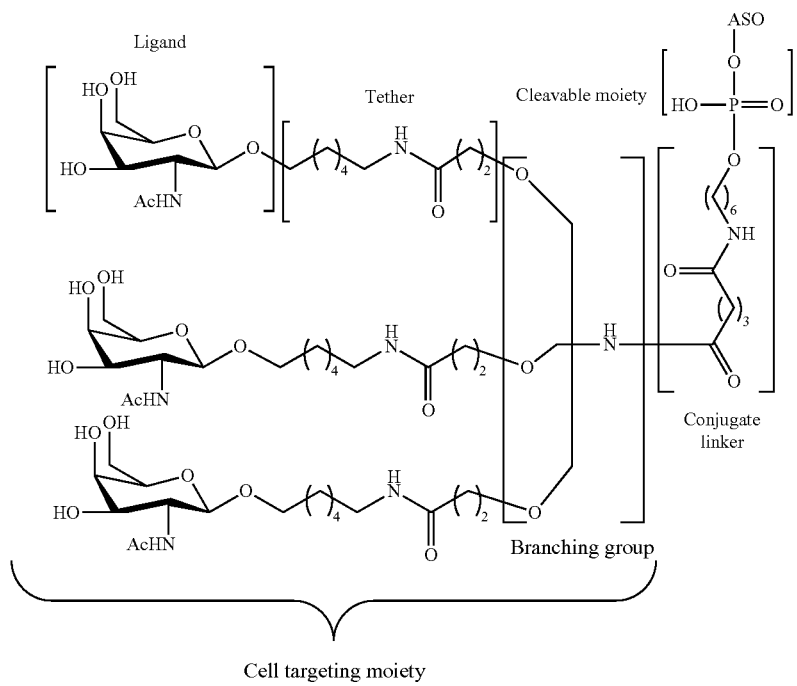

The present disclosure provides the following non-limiting numbered embodiments:

Embodiment 1

A conjugated antisense compound comprising: an antisense oligonucleotide comprising 12-30 linked nucleosides and a conjugate group, wherein the conjugate group comprises: a cleavable moiety; a conjugate linker; and a cell-targeting moiety.

Embodiment 2

The conjugated antisense compound of embodiment 1, wherein:
the cleavable moiety is covalently bound to the antisense oligonucleotide;
the conjugate linker is covalently bound to the cleavable moiety; and
the cell-targeting moiety is covalently bound to the conjugate linker.

Embodiment 3

The conjugated antisense compound of embodiment 1 or 2, wherein the cell-targeting moiety comprises a branching group.

Embodiment 4

The conjugated antisense compound of embodiment 3, wherein the branching group is covalently attached to the conjugate linker.

Embodiment 5

The conjugated antisense compound of any of embodiments 1-4, wherein the cell-targeting moiety comprises at least one tether.

Embodiment 6

The conjugated antisense compound of embodiment 5, wherein the at least one tether is covalently attached to the branching group.

Embodiment 7

The conjugated antisense compound of any of embodiments 1-6, wherein the cell-targeting moiety comprises at least one ligand.

Embodiment 8

The conjugated antisense compound of embodiment 7, wherein each of the at least one ligands is covalently attached to a tether.

Embodiment 9

The conjugated antisense compound of embodiment 1-8, wherein the compound has a structure represented by formula I below:

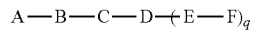

wherein
A is the antisense oligonucleotide;
B is the cleavable moiety
C is the conjugate linker
D is the branching group
each E is a tether;
each F is a ligand; and
q is an integer between 1 and 5.

Embodiment 10

The conjugated antisense compound of any of embodiments 1-9, wherein the cleavable moiety comprises 1-4 linked cleavable moiety nucleosides, wherein the linkage between the antisense oligonucleotide and the first cleavable moiety nucleoside is a phosphodiester internucleoside linkage.

Embodiment 11

The conjugated antisense compound of embodiment 10, wherein each internucleoside linkage between each of the linked cleavable moiety nucleosides is a phosphodiester internucleoside linkage.

Embodiment 12

The conjugated antisense compound of embodiment 10 or 11, wherein the cleavable moiety comprises 1-3 linked cleavable moiety nucleosides.

Embodiment 13

The conjugated antisense compound of embodiment 10 or 11, wherein the cleavable moiety comprises 1-2 linked cleavable moiety nucleosides.

Embodiment 14

The conjugated antisense compound of embodiment 10, wherein the cleavable moiety comprises one cleavable moiety nucleoside.

Embodiment 15

The conjugated antisense compound of any of embodiments 1-14, wherein the cleavable moiety is a cleavable moiety nucleoside selected from the group consisting of a purine, a substituted purine, a pyrimidine, or a substituted pyrimidine.

Embodiment 16

The conjugated antisense compound of any of embodiments 1-14, wherein the cleavable moiety is a cleavable moiety nucleoside selected from cytidine, uridine, adenosine, thymidine, and guanosine.

Embodiment 17

The conjugated antisense compound of any of embodiments 1-14, wherein the cleavable moiety is a cleavable moiety deoxynucleoside selected from deoxyadenosine, deoxyguanosine, deoxyinosine, thymidine, deoxyuridine, and deoxycytidine.

Embodiment 18

The conjugated antisense compound of any of embodiments 1-17, wherein the cleavable moiety comprises deoxyadenosine.

Embodiment 19

The conjugated antisense compound of any of embodiments 1-18, wherein the cleavable moiety is deoxyadenosine.

Embodiment 20

The conjugated antisense compound of any of embodiments 1-19, wherein the cleavable moiety has a structure selected from among:

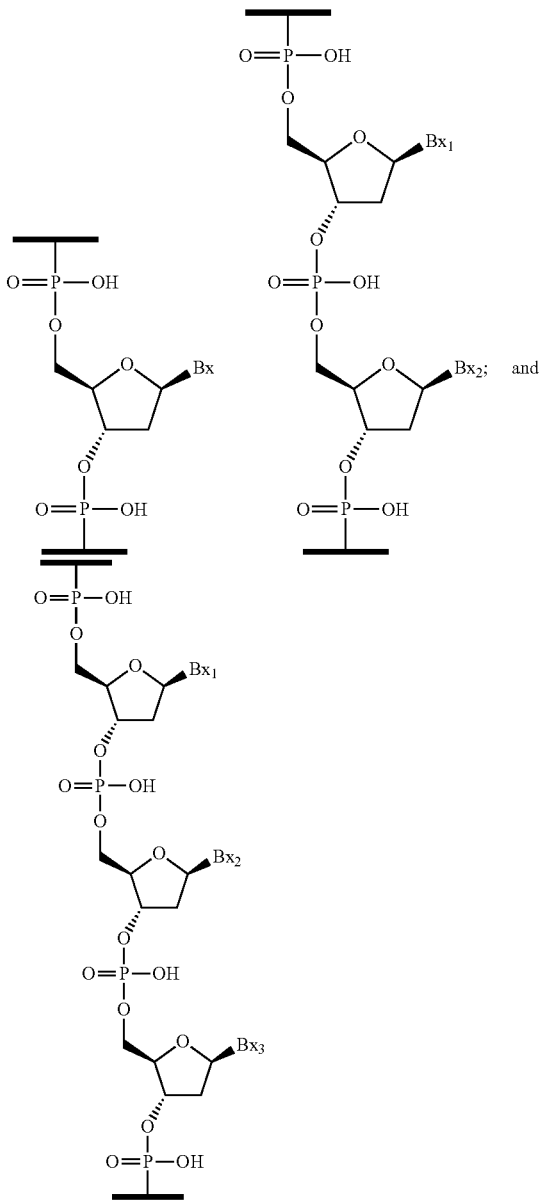

wherein each of Bx, Bx₁, Bx₂, and Bx₃ is independently a heterocyclic base moiety.

Embodiment 21

The conjugated antisense compound of embodiment 20, wherein the heterocyclic base moiety is selected from among: uracil, thymine, cytosine, 5-methylcytosine, adenine or guanine.

Embodiment 22

The conjugated antisense compound of any of embodiments 1-19, wherein the cleavable moiety has the structure:

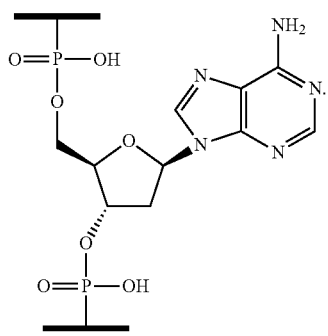

Embodiment 23

The conjugated antisense compound of any of embodiments 1-22, wherein the conjugate linker comprises a pyrrolidine.

Embodiment 24

The conjugated antisense compound of any of embodiments 1-23, wherein the conjugate linker comprises PEG.

Embodiment 25

The conjugated antisense compound of any of embodiments 1-24, wherein the conjugate linker comprises an amide.

Embodiment 26

The conjugated antisense compound of any of embodiments 1-25, wherein the conjugate linker comprises a polyamide.

Embodiment 27

The conjugated antisense compound of any of embodiments 1-26, wherein the conjugate linker comprises an amine Embodiment 28

The conjugated antisense compound of any of embodiments 1-27, wherein the conjugate linker comprises one or more disulfide bonds.

Embodiment 29

The conjugated antisense compound of any of embodiments 1-28, wherein the conjugate linker comprises a protein binding moiety.

Embodiment 30

The conjugated antisense compound of embodiment 29, wherein the protein binding moiety comprises a lipid.

Embodiment 31

The conjugated antisense compound of embodiment 30, wherein the protein binding moiety is selected from among: cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, sarsasapogenin, friedelin, epifriedelanol derivatized lithocholic acid), or a cationic lipid.

Embodiment 32

The conjugated antisense compound of any of embodiments 1-31 wherein the protein binding moiety is a C16 to C22 long chain saturated or unsaturated fatty acid, cholesterol, cholic acid, vitamin E, adamantane or 1-pentafluoropropyl.

Embodiment 33

The conjugated antisense compound of any of embodiments 1-32 wherein the conjugate linker has a structure selected from among:

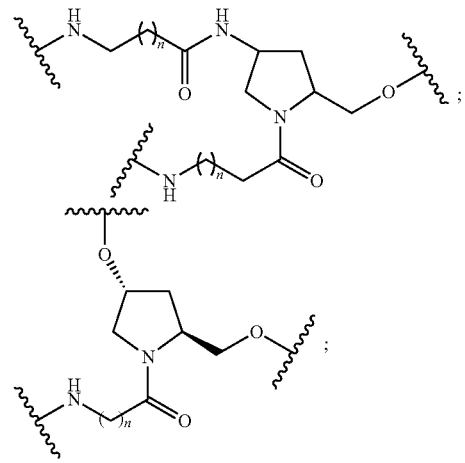

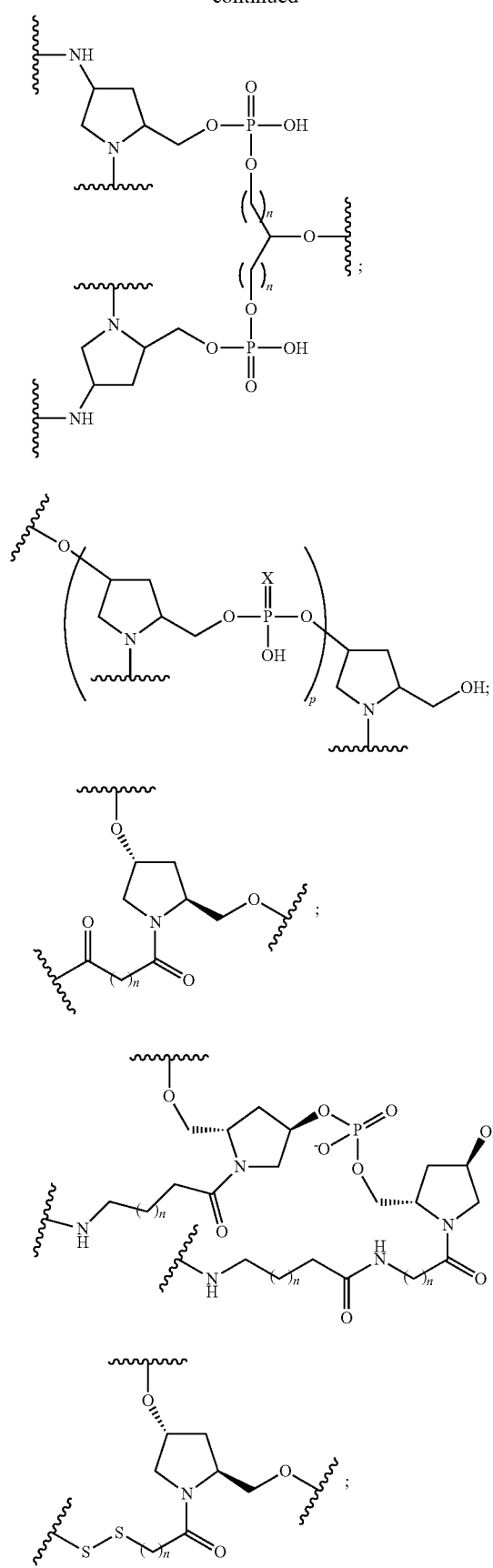
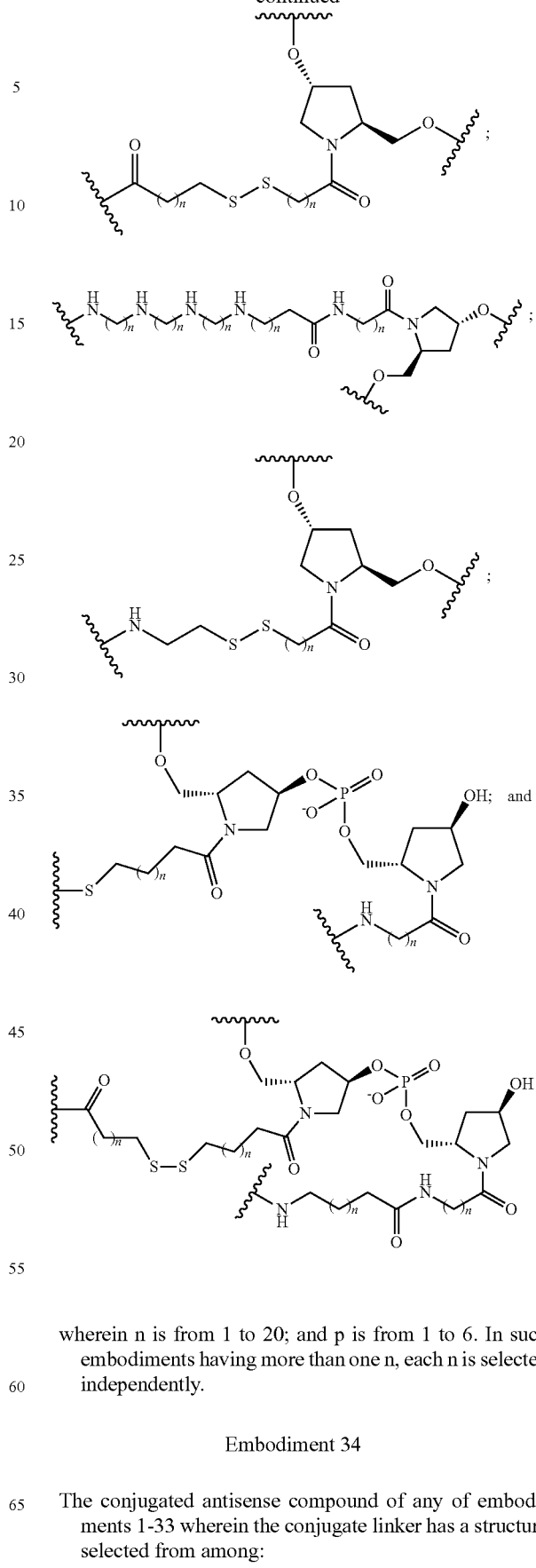
wherein n is from 1 to 20; and p is from 1 to 6. In such embodiments having more than one n, each n is selected independently.
Embodiment 34
The conjugated antisense compound of any of embodiments 1-33 wherein the conjugate linker has a structure selected from among:

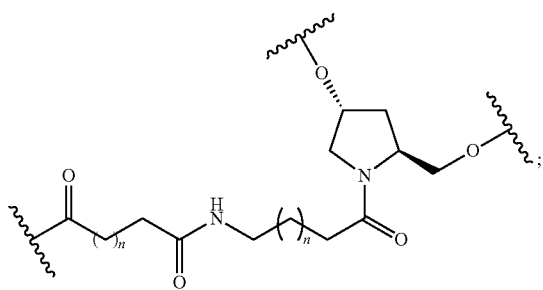
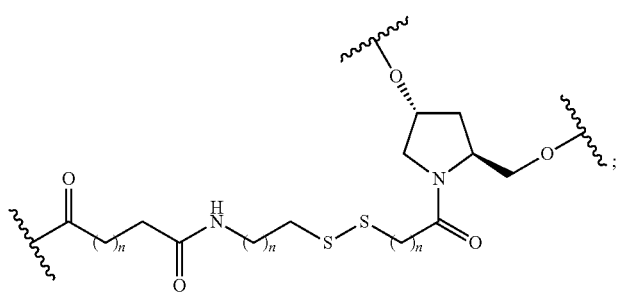
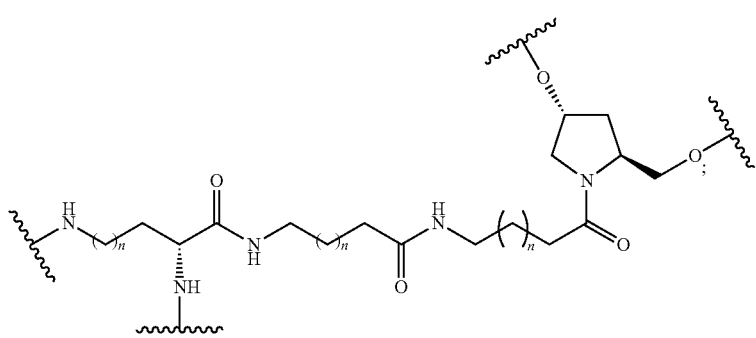
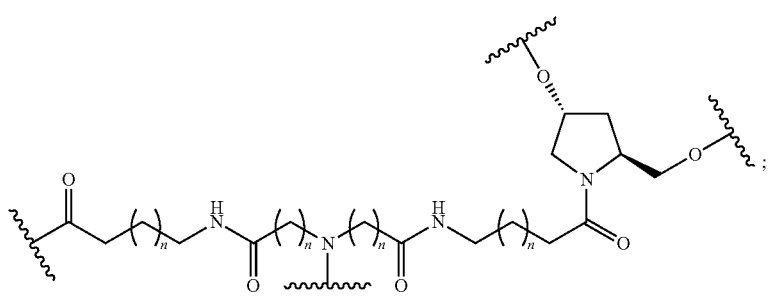
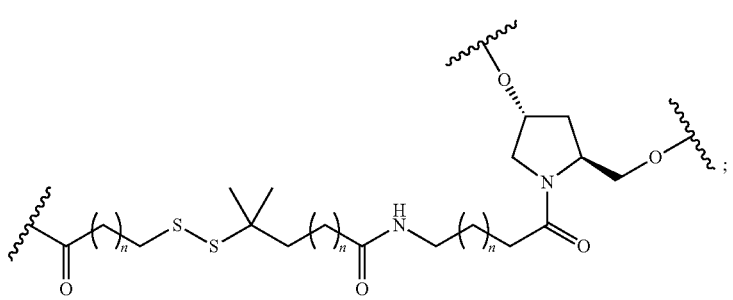

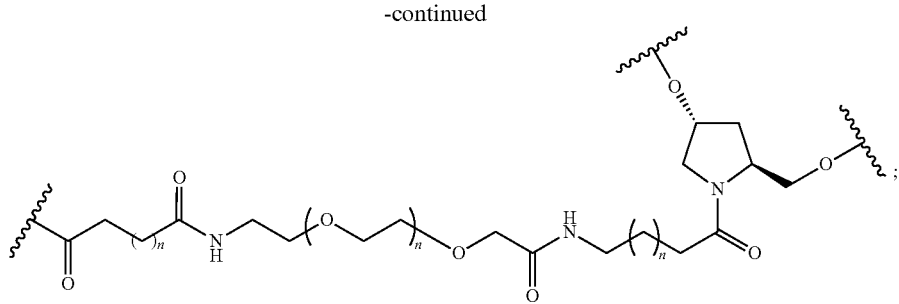
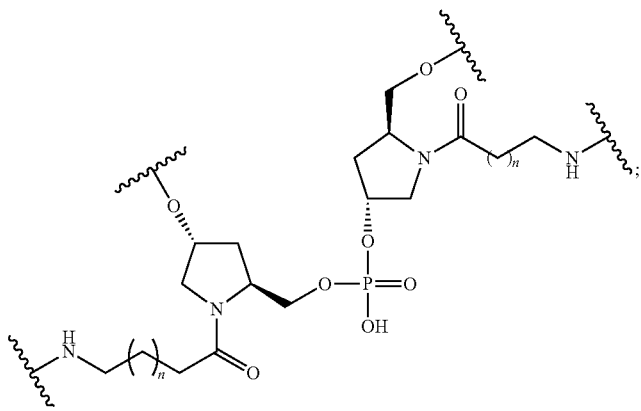
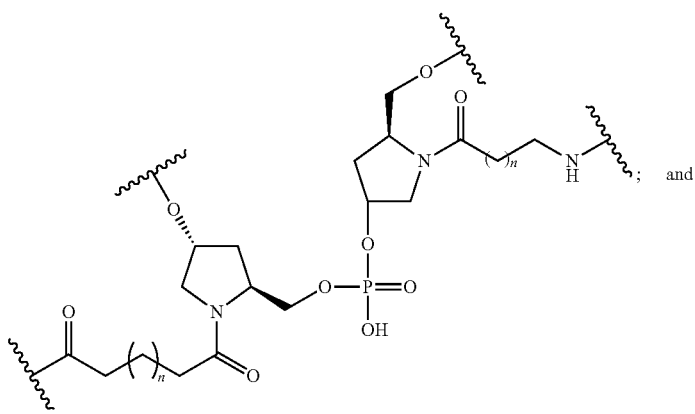
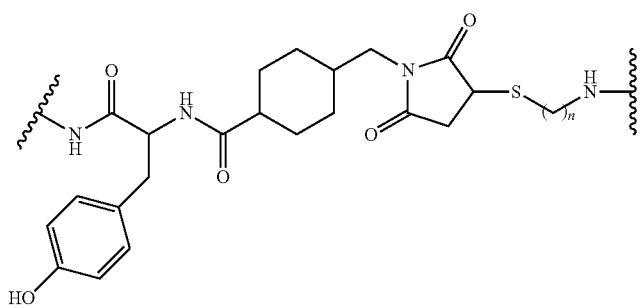
wherein n is from 1 to 20.
Embodiment 35
The conjugated antisense compound of any of embodiments 1-33 wherein the conjugate linker has a structure selected from among:
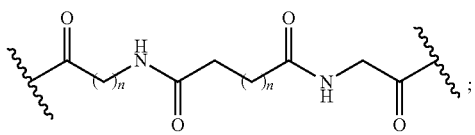

-continued
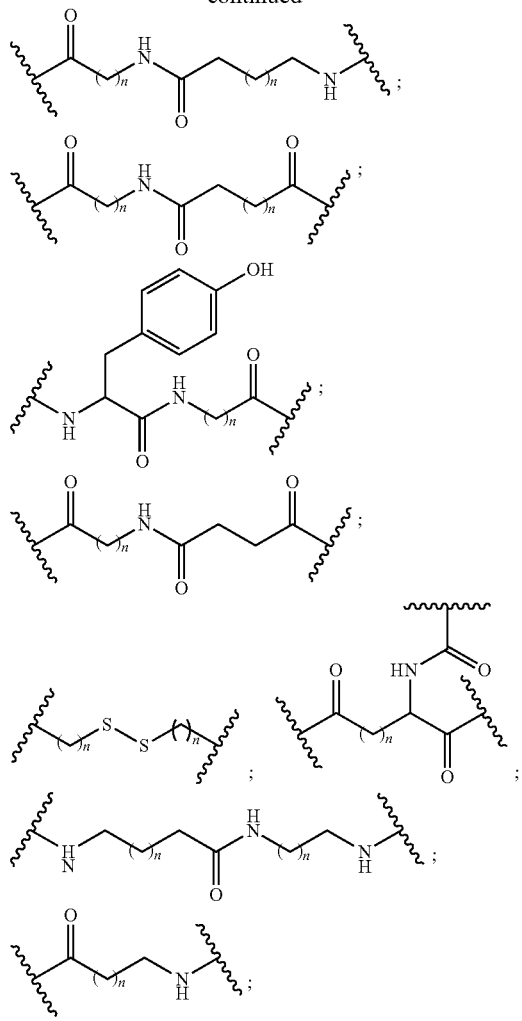
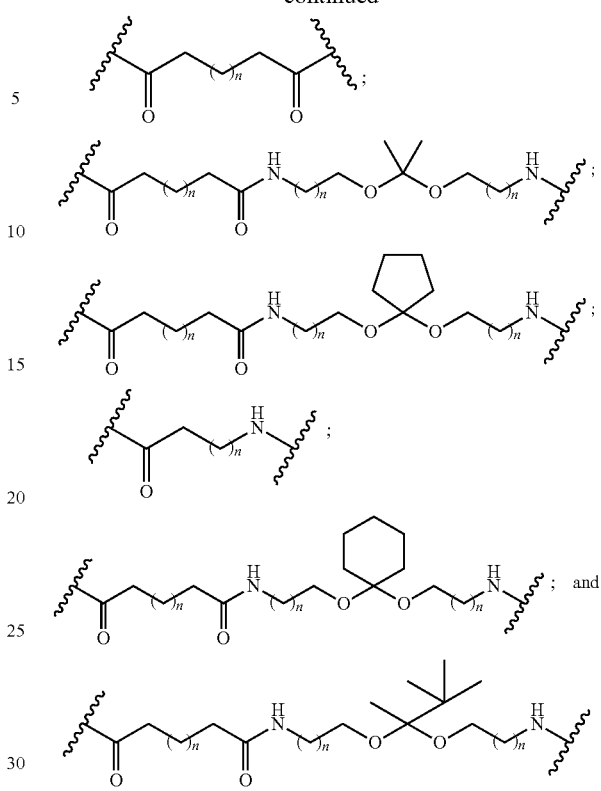
wherein n is from 1 to 20.
Embodiment 36
The conjugated antisense compound of any of embodiments 1-33 wherein the conjugate linker has a structure selected from among:
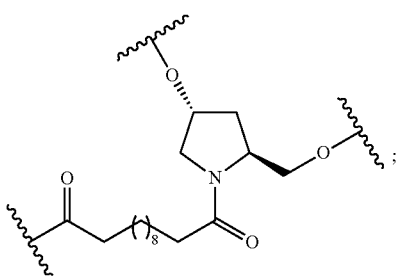
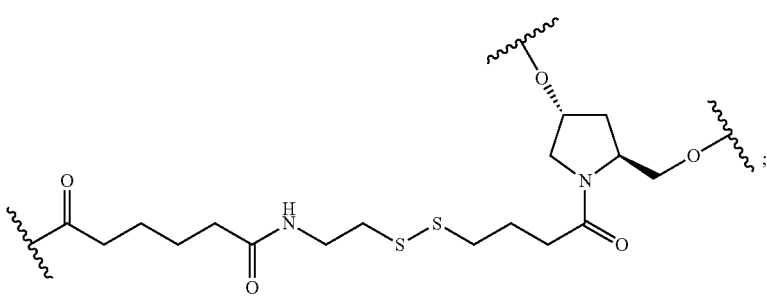

-continued
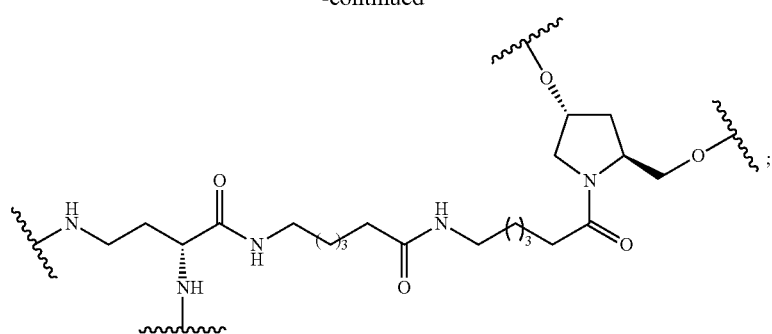
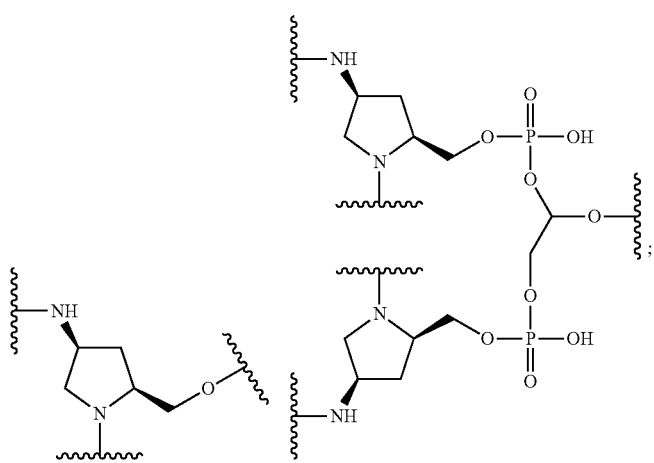
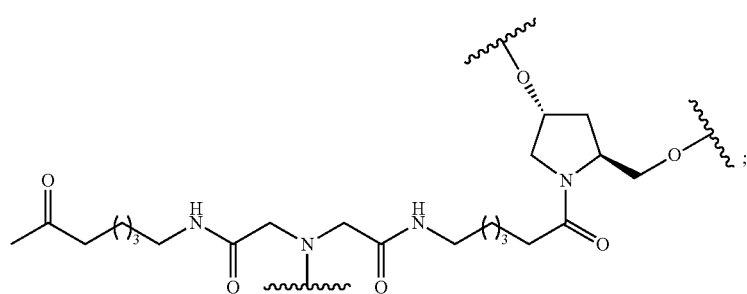
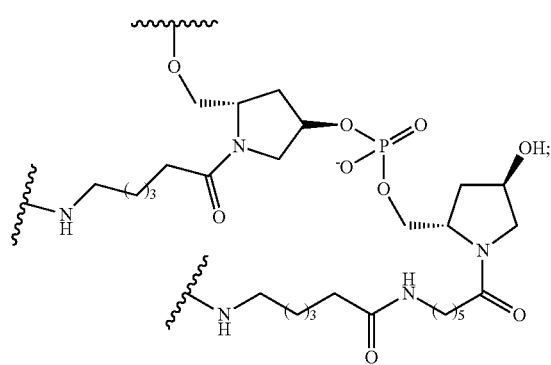

-continued
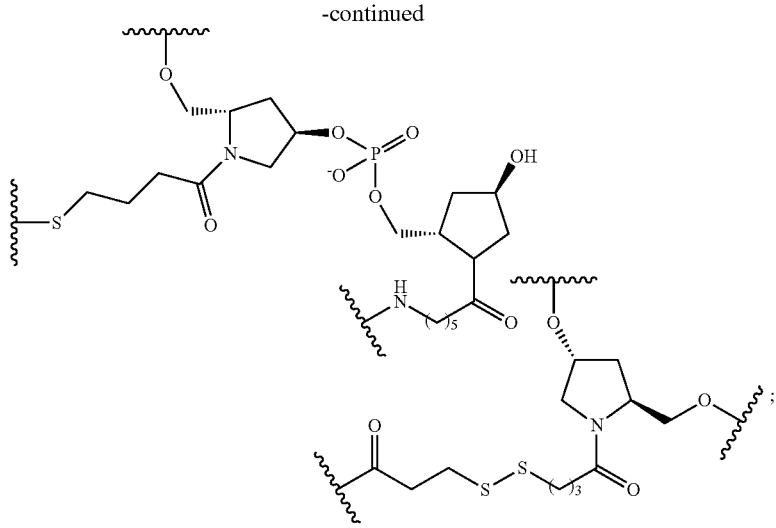
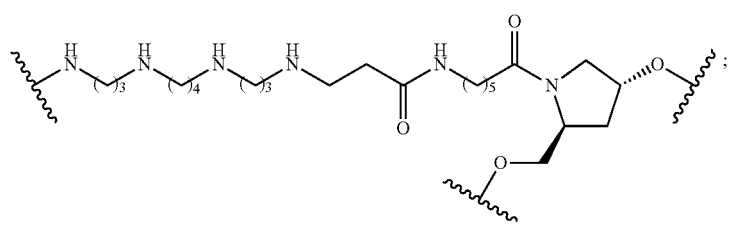
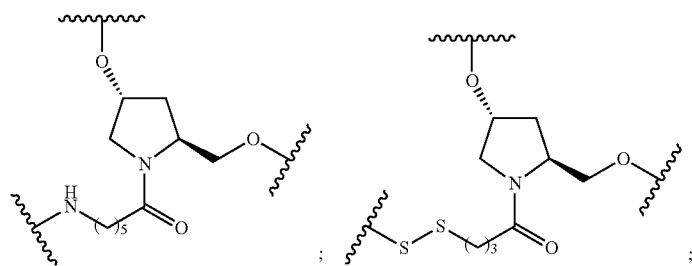
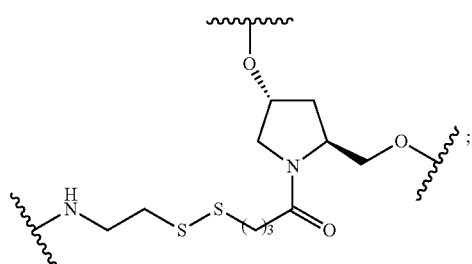
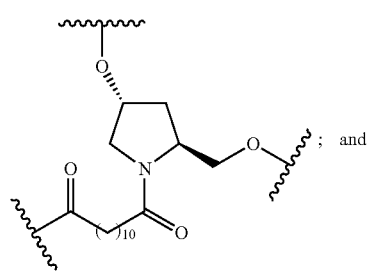

-continued
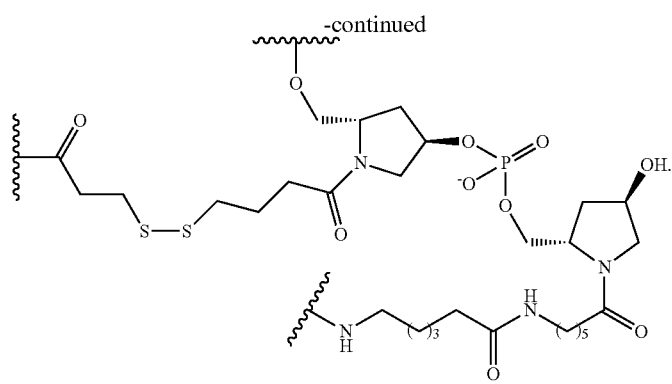
Embodiment 37
The conjugated antisense compound of any of embodiments 1-33 wherein the conjugate linker has a structure selected from among:
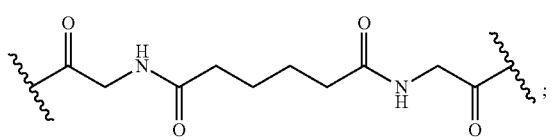
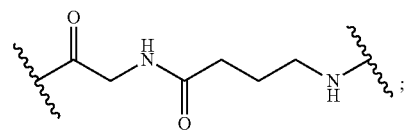
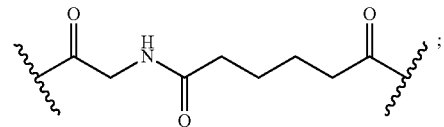
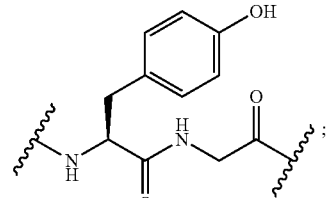
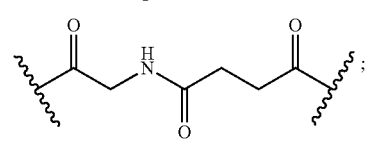
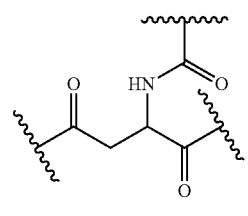
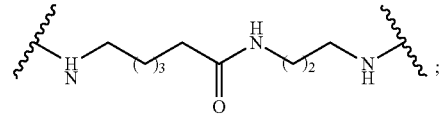
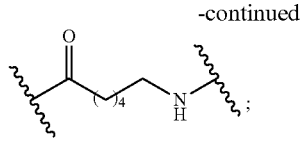
-continued
Embodiment 38
The conjugated antisense compound of any of embodiments 1-33 wherein the conjugate linker has a structure selected from among:

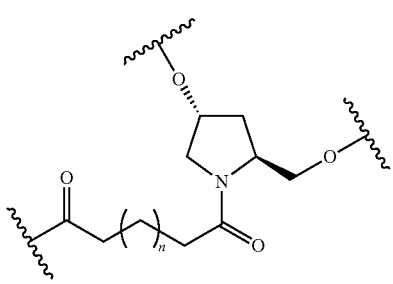

and

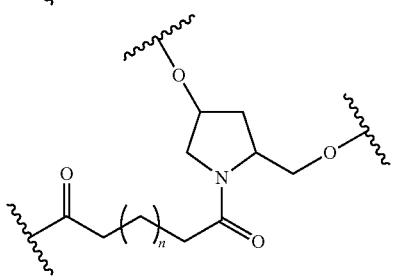

wherein n is from 1 to 20.

Embodiment 39

The conjugated antisense compound of any of embodiments 1-33 wherein the conjugate linker has the structure:

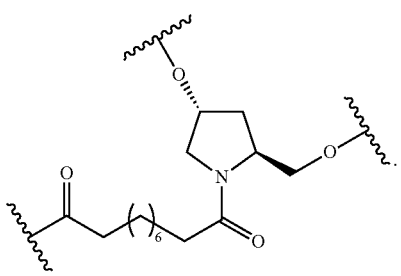

Embodiment 40

The conjugated antisense compound of any of embodiments 1-39, wherein the cell-targeting moiety comprises a carbohydrate.

Embodiment 41

The conjugated antisense compound of any of embodiments 1-40, wherein the cell-targeting moiety comprises a carbohydrate cluster.

Embodiment 42

The conjugated antisense compound of any of embodiments 1-41, wherein the cell-targeting moiety comprises a cell surface receptor ligand.

Embodiment 43

The conjugated antisense compound of any of embodiments 1-42, wherein the targeting moiety comprises at least one N-Acetylgalactosamine (GalNAc).

Embodiment 44

The conjugated antisense compound of any of embodiments 1-43, wherein the targeting moiety comprises a branching group.

Embodiment 45

The conjugated antisense compound of embodiment 44, wherein the branching group comprises an ether.

Embodiment 46

The conjugated antisense compound of embodiment 44 or 45, wherein the branching group has the following structure:

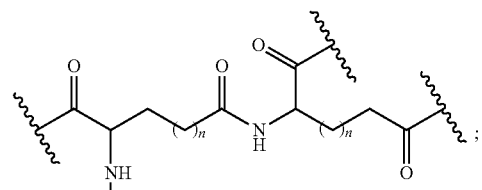

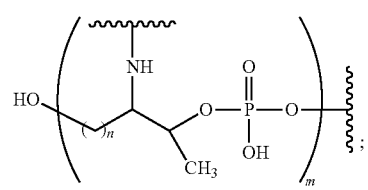

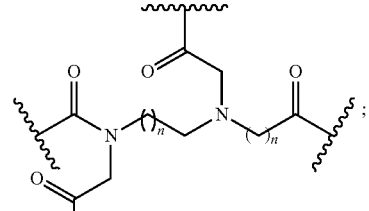

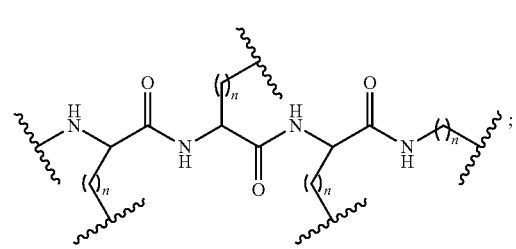

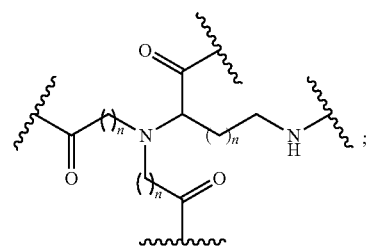

33
-continued
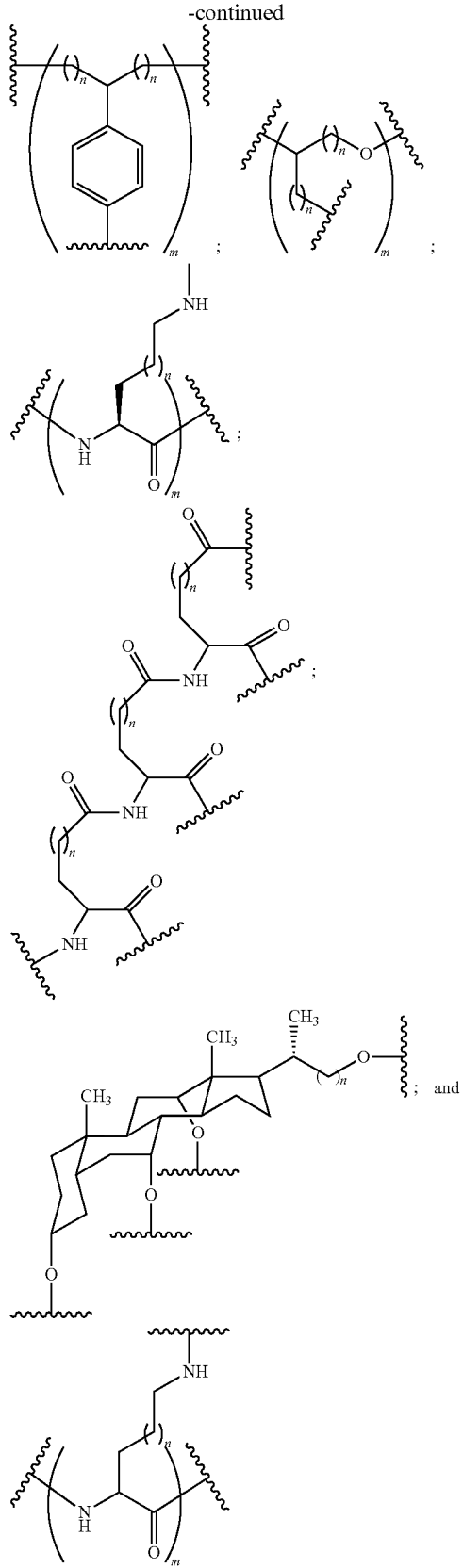
wherein each n is, independently, from 1 to 20; and
m is from 2 to 6.
34
Embodiment 47
The conjugated antisense compound of embodiment 44 or 45, wherein the branching group has the following structure:
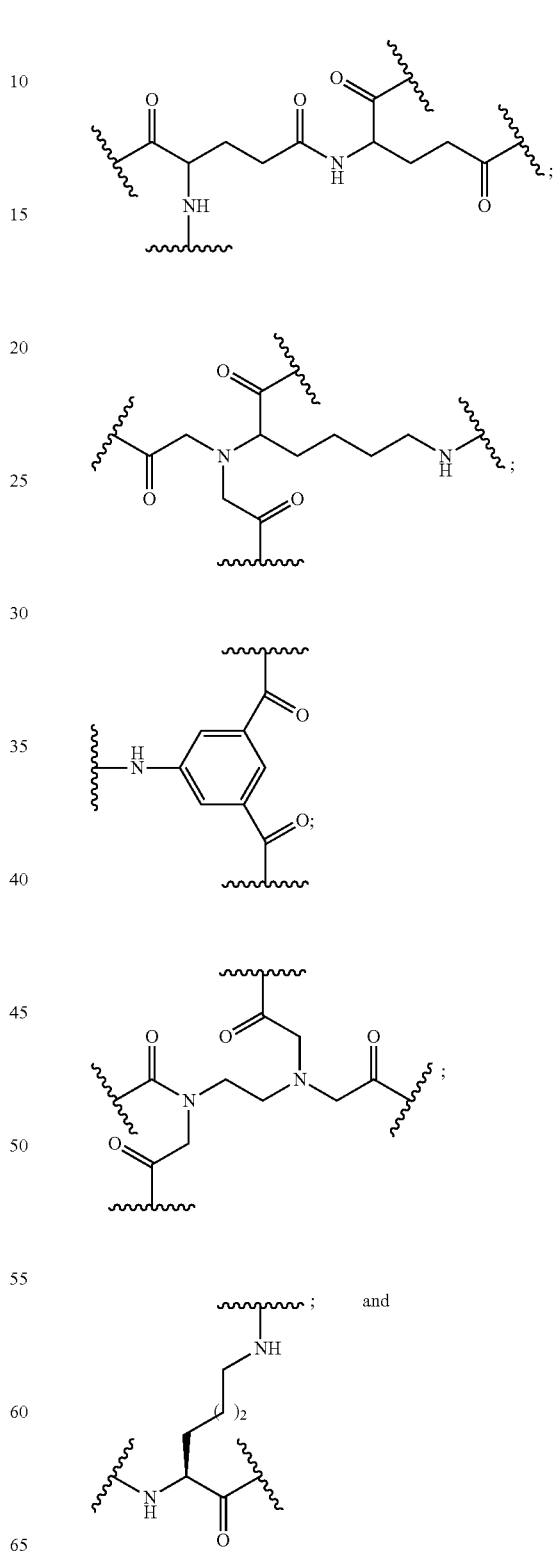

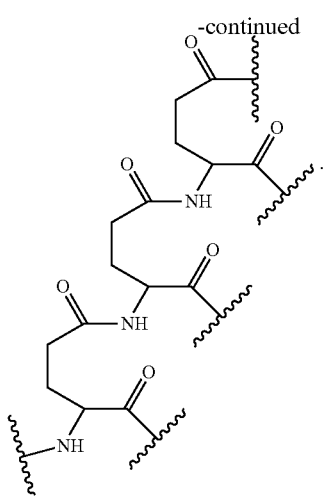

Embodiment 48

The conjugated antisense compound of embodiment 44 or 45, wherein the branching group has the following structure:

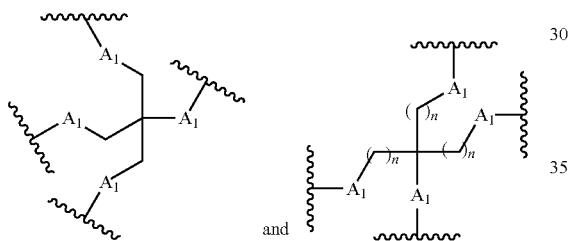

and wherein each $A_1$ is independently, O, S, C=O or NH; and each n is, independently, from 1 to 20.

Embodiment 49

The conjugated antisense compound of embodiment 44 or 45, wherein the branching group has the following structure:

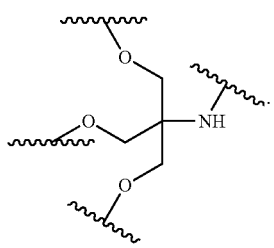 [SMILES: *NC(CO*)(CO*)CO*]

Embodiment 50

The conjugated antisense compound of any embodiments 1-49, wherein the cell-targeting moiety comprises a tether.

Embodiment 51

The conjugated antisense compound of any embodiments 1-49, wherein the cell-targeting moiety comprises two tethers.

Embodiment 52

The conjugated antisense compound of any embodiments 1-49, wherein the cell-targeting moiety comprises three tethers.

Embodiment 53

The conjugated antisense compound of any embodiments 1-49, wherein the cell-targeting moiety comprises four or more tethers.

Embodiment 54

The conjugated antisense compound of any of embodiments 1-53, wherein at least one tether comprises PEG.

Embodiment 55

The conjugated antisense compound of any of embodiments 1-54, wherein at least one tether comprises an amide.

Embodiment 56

The conjugated antisense compound of any of embodiments 1-55, wherein at least one tether comprises a polyamide.

Embodiment 57

The conjugated antisense compound of any of embodiments 1-56, wherein at least one tether comprises an amine

Embodiment 58

The conjugated antisense compound of any of embodiments 1-57, wherein at least two tethers are different from one another.

Embodiment 59

The conjugated antisense compound of any of embodiments 1-57, wherein all of the tethers are the same as one another.

Embodiment 60

The conjugated antisense compound of any of embodiments 1-59, wherein each tether is selected from among:

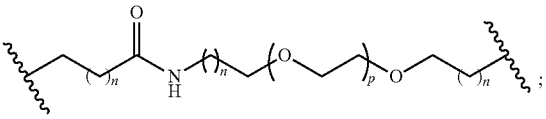

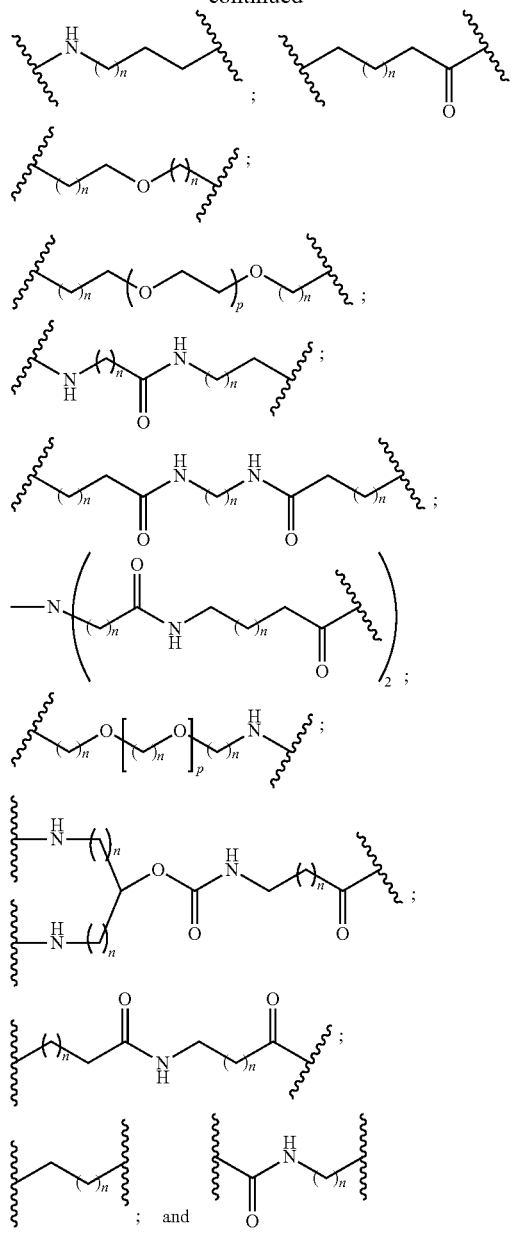

wherein each n is, independently, from 1 to 20; and each p is from 1 to about 6.

Embodiment 61

The conjugated antisense compound of any of embodiments 1-60, wherein each tether is selected from among:

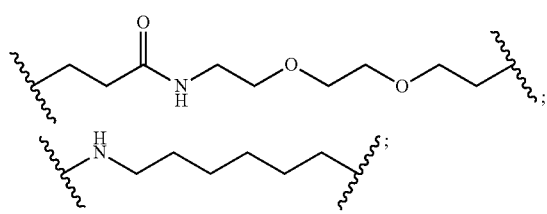

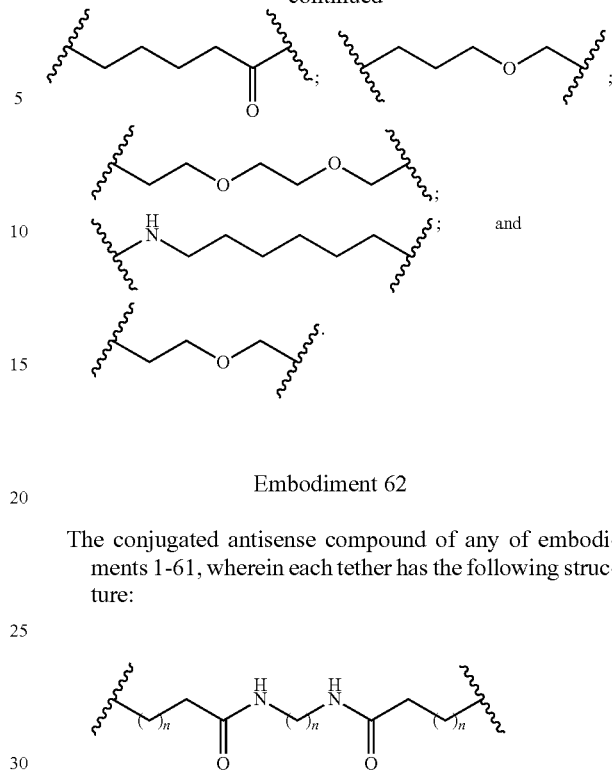

Embodiment 62

The conjugated antisense compound of any of embodiments 1-61, wherein each tether has the following structure:

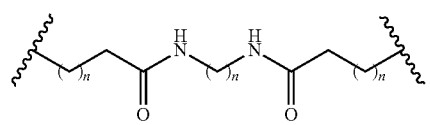

wherein each n is, independently, from 1 to 20.

Embodiment 63

The conjugated antisense compound of any of embodiments 1-61, wherein each tether has the following structure:

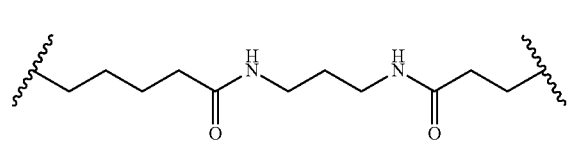 [SMILES: *CCCCC(=O)NCCCNC(=O)CC*]

Embodiment 64

The conjugated antisense compound of any of embodiments 1-63, wherein the cell-targeting moiety comprises at least one ligand.

Embodiment 65

The conjugated antisense compound of embodiment 64, wherein the cell-targeting moiety comprises one ligand.

Embodiment 66

The conjugated antisense compound of embodiment 64, wherein the targeting moiety comprises two ligands.

Embodiment 67

The conjugated antisense compound of embodiment 64, wherein the targeting moiety comprises three ligands.

Embodiment 68

The conjugated antisense compound of any of embodiments 64-67, wherein a ligand is covalently attached to each tether.

Embodiment 69

The conjugated antisense compound of any of embodiments 1 to 68, wherein at least one ligand is N-Acetylgalactosamine (GalNAc).

Embodiment 70

The conjugated antisense compound of any of embodiments 1 to 69, wherein each ligand is N-Acetylgalactosamine (GalNAc).

Embodiment 71

The conjugated antisense compound of any of embodiments 1-70, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, β-D-Mannofuranose, α-D-Mannopyranose, β-D-Mannopyranose, α-D-Glucopyranose, β-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 72

The conjugated antisense compound of any of embodiments 1-71, wherein the ligand is galactose.

Embodiment 73

The conjugated antisense compound of any of embodiments 1-71, wherein the ligand is mannose-6-phosphate.

Embodiment 74

The conjugated antisense compound of any of embodiments 1-71, wherein each ligand is selected from among:

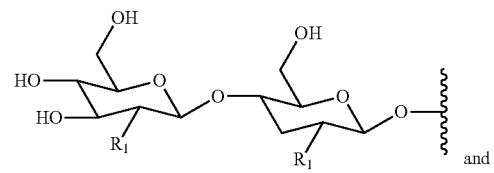

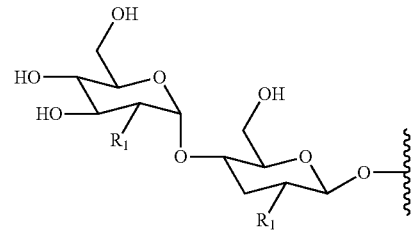

wherein each $R_1$ is selected from OH and NHCOOH.

Embodiment 75

The conjugated antisense compound of any of embodiments 1-71, wherein each ligand is selected from among:

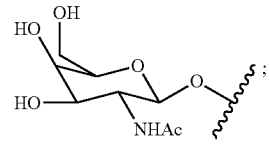

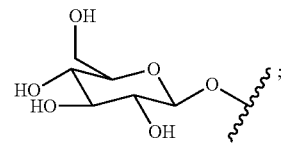

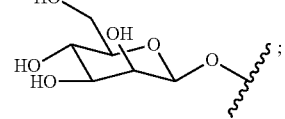

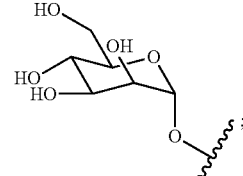

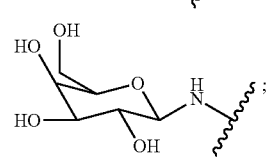

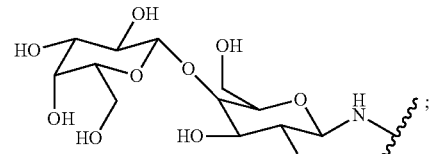

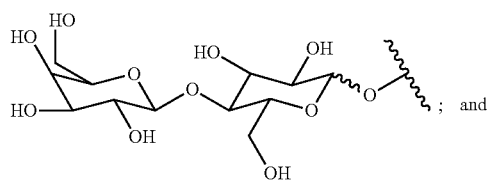 ; and

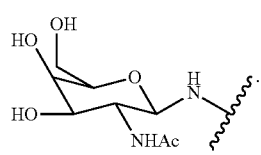 [SMILES: *OC1OC(CO)C(O)C(O)C1NC(C)=O]

Embodiment 77

The conjugated antisense compound of any of embodiments 1-71, wherein each ligand has the following structure:

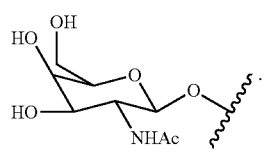

Embodiment 78

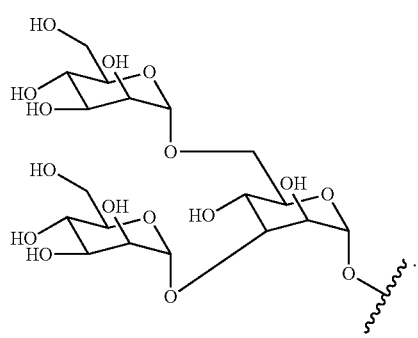

Embodiment 76

The conjugated antisense compound of any of embodiments 1-71, wherein each ligand has the following structure:

The conjugated antisense compound of any of embodiments 1-77, wherein the cell-targeting group has the following structure:

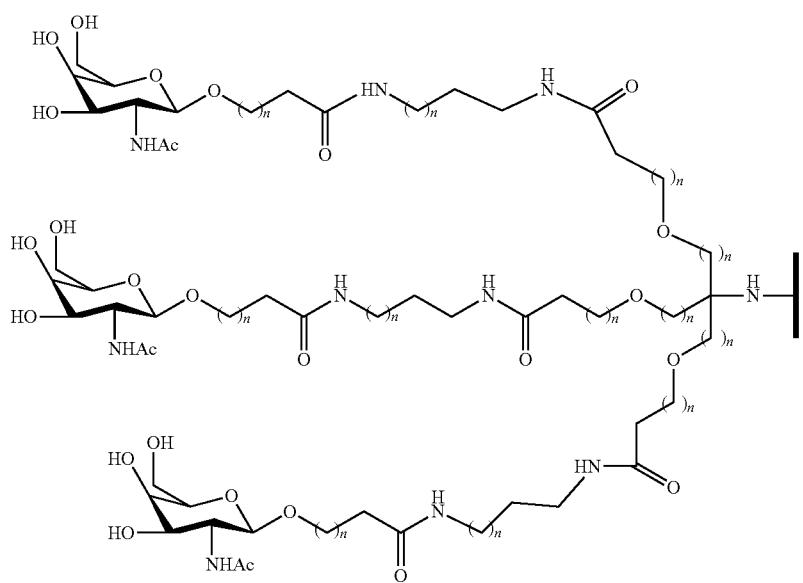

wherein each n is, independently, from 1 to 20.

Embodiment 79
The conjugated antisense compound of any of embodiments 1-77, wherein the cell-targeting group has the following structure:
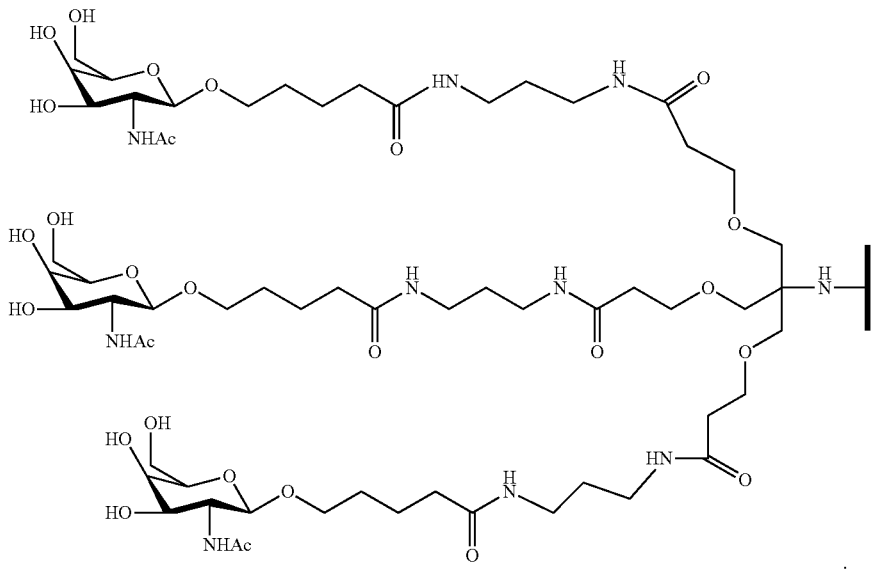
Embodiment 80
The conjugated antisense compound of any of embodiments 1-79, wherein the conjugate has the following structure:
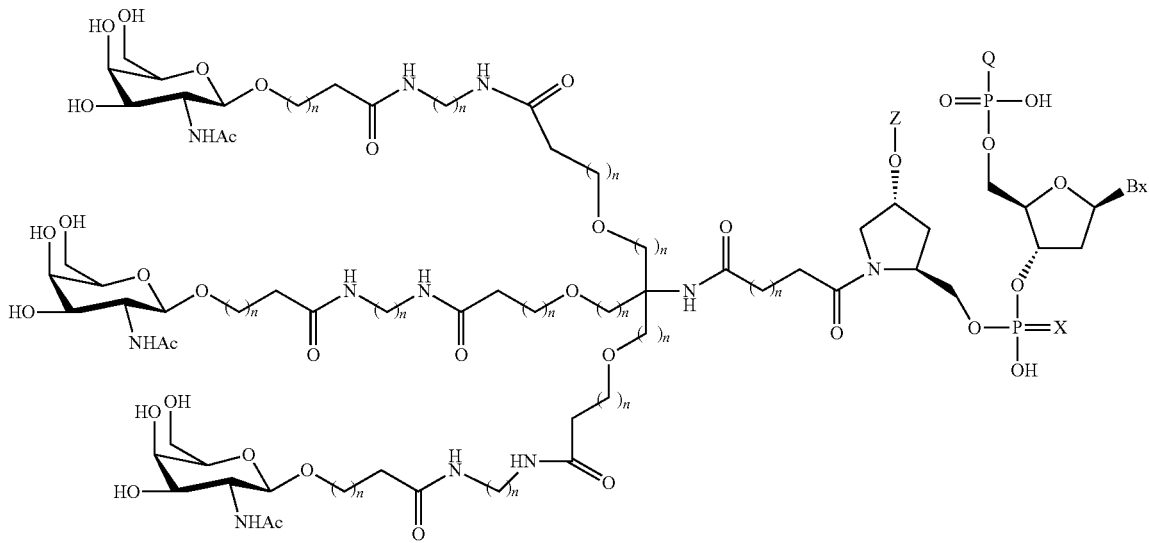

wherein each n is, independently, from 1 to 20;
Z is H or a linked solid support;
Q is said antisense compound;
X is O or S; and
Bx is a heterocyclic base moiety.

Embodiment 81

The conjugated antisense compound of any of embodiments 1-79, wherein the conjugate has the following structure:

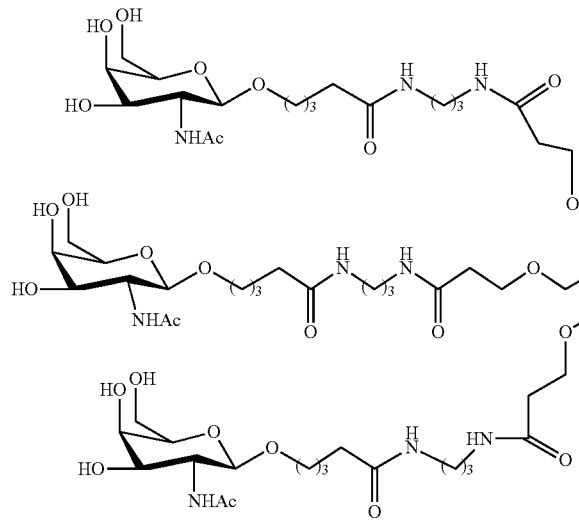
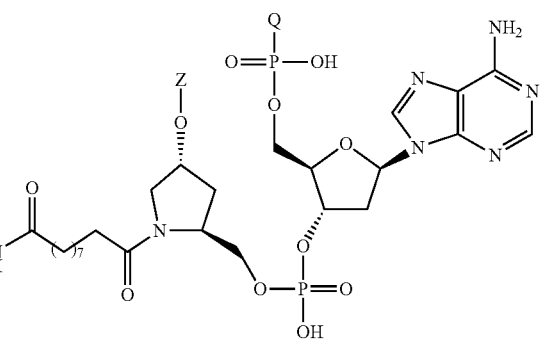

wherein Z is H or a linked solid support;
Q is said antisense compound.

Embodiment 82

The conjugated antisense compound of any of embodiments 1-81, wherein the conjugate group is attached to the 2'-position of a nucleoside of the antisense oligonucleotide.

Embodiment 83

The conjugated antisense compound of any of embodiments 1-81, wherein the conjugate group is attached to the 3'-position of a nucleoside of the antisense oligonucleotide.

Embodiment 84

The conjugated antisense compound of any of embodiments 1-81, wherein the conjugate group is attached to the 5'-position of a nucleoside of the antisense oligonucleotide.

Embodiment 85

The conjugated antisense compound of any of embodiments 1-82, wherein the conjugate group is attached to the 5'-terminal nucleoside of the antisense oligonucleotide.

Embodiment 86

The conjugated antisense compound of any of embodiments 1-84, wherein the conjugate group is attached to the 3'-terminal nucleoside of the antisense oligonucleotide.

Embodiment 87

The conjugated antisense compound of any of embodiments 1-84, wherein the conjugate group is attached to an internal nucleoside of the antisense oligonucleotide.

Embodiment 88

The conjugated antisense compound of any of embodiments 1-87, wherein the conjugate group increases uptake of the conjugated antisense compound into a hepatocyte relative to an unconjugated antisense compound.

Embodiment 89

The conjugated antisense compound of any of embodiments 1-88, wherein the conjugate group increases the uptake of the conjugated antisense compound into a liver cell relative to an unconjugated antisense compound.

Embodiment 90

The conjugated antisense compound of any of embodiments 1-89, wherein the conjugate group increases accumulation of the conjugated antisense compound in the liver relative to an unconjugated antisense compound.

Embodiment 91

The conjugated antisense compound of any of embodiments 1-90, wherein the conjugate group decreases accumulation of the conjugated antisense compound in the kidneys relative to an unconjugated antisense compound.

Embodiment 92

The conjugated antisense compound of any of embodiments 1-91, wherein the antisense oligonucleotide is an RNase H based antisense compound.

Embodiment 93

The conjugated antisense compound of any of embodiments 1-92, wherein the antisense oligonucleotide comprises at least one modified nucleoside.

Embodiment 94

The conjugated antisense compound of any of embodiments 1-93, wherein each nucleoside of the antisense oligonucleotide is a modified nucleoside.

Embodiment 95

The conjugated antisense compound of any of embodiments 1-94, wherein the antisense oligonucleotide is single-stranded.

Embodiment 96

The conjugated antisense compound of embodiment 93-95, wherein at least one modified nucleoside comprises a modified sugar moiety.

Embodiment 97

The conjugated antisense compound of embodiment 96, wherein the antisense oligonucleotide has a sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 98

The conjugated antisense compound of embodiment 97, wherein the 5'-region consists of 2 linked 5'-region nucleosides.

Embodiment 99

The conjugated antisense compound of embodiment 97, wherein the 5'-region consists of 3 linked 5'-region nucleosides.

Embodiment 100

The conjugated antisense compound of embodiment 97, wherein the 5'-region consists of 4 linked 5'-region nucleosides.

Embodiment 101

The conjugated antisense compound of embodiment 97, wherein the 5'-region consists of 5 linked 5'-region nucleosides.

Embodiment 102

The conjugated antisense compound of any of embodiments 97-101, wherein the 3'-region consists of 2 linked 3'-region nucleosides.

Embodiment 103

The conjugated antisense compound of any of embodiments 97-101, wherein the 3'-region consists of 3 linked 3'-region nucleosides.

Embodiment 104

The conjugated antisense compound of any of embodiments 97-91, wherein the 3'-region consists of 4 linked 3'-region nucleosides.

Embodiment 105

The conjugated antisense compound of any of embodiments 97-101, wherein the 3'-region consists of 5 linked 3'-region nucleosides.

Embodiment 106

The conjugated antisense compound of any of embodiments 97-105, wherein the central region consists of 5 linked central region nucleosides.

Embodiment 107

The conjugated antisense compound of any of embodiments 97-105, wherein the central region consists of 6 linked central region nucleosides.

Embodiment 108

The conjugated antisense compound of any of embodiments 97-105, wherein the central region consists of 7 linked central region nucleosides.

Embodiment 109

The conjugated antisense compound of any of embodiments 97-105, wherein the central region consists of 8 linked central region nucleosides.

Embodiment 110

The conjugated antisense compound of any of embodiments 97-105, wherein the central region consists of 9 linked central region nucleosides.

Embodiment 111

The conjugated antisense compound of any of embodiments 97-105, wherein the central region consists of 10 linked central region nucleosides.

Embodiment 112

The conjugated antisense compound of any of embodiments 1-111, wherein the antisense oligonucleotide consists of 14 to 26 linked nucleosides.

Embodiment 113

The conjugated antisense compound of any of embodiments 1-111, wherein the antisense oligonucleotide consists of 15 to 25 linked nucleosides.

Embodiment 114

The conjugated antisense compound of any of embodiments 1-111, wherein the antisense oligonucleotide consists of 16 to 20 linked nucleosides.

Embodiment 115

The conjugated antisense compound of any of embodiments 1-114, wherein each modified nucleoside independently comprises a 2'-substituted sugar moiety or a bicyclic sugar moiety.

Embodiment 116

The conjugated antisense compound of embodiment 115, wherein the at least one modified nucleoside comprises a 2'-substituted sugar moiety.

Embodiment 117

The conjugated antisense compound of embodiment 116, wherein each modified nucleoside comprising a 2'-substituted sugar moiety comprises a 2' substituent independently selected from among: halogen, optionally substituted allyl, optionally substituted amino, azido, optionally substituted SH, CN, OCN, $CF_3$, $OCF_3$, O, S, or N(Rm)-alkyl; O, S, or N(Rm)-alkenyl; O, S or N(Rm)-alkynyl; optionally substituted O-alkylenyl-O-alkyl, optionally substituted alkynyl, optionally substituted alkaryl, optionally substituted aralkyl, optionally substituted O-alkaryl, optionally substituted O-aralkyl, $O(CH_2)_2SCH_3$, $O-(CH_2)_2-O-N(Rm)(Rn)$ or $O-CH2-C(=O)-N(Rm)(Rn)$, where each Rm and Rn is, independently, H, an amino protecting group or substituted or unsubstituted $C_1-C_{10}$ alkyl;

wherein each optionally substituted group is optionally substituted with a substituent group independently selected from among: hydroxyl, amino, alkoxy, carboxy, benzyl, phenyl, nitro ($NO_2$), thiol, thioalkoxy (S-alkyl), halogen, alkyl, aryl, alkenyl and alkynyl.

Embodiment 118

The conjugated antisense compound of embodiment 116, wherein each 2' substituent is independently selected from among: a halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2-CH=CH_2$, $O(CH_2)_2-OCH_3$, $O(CH_2)_2-SCH_3$, $O(CH_2)_2-OCF_3$, $O(CH_2)_3-N(R_1)(R_2)$, $O(CH_2)_2-ON(R_1)(R_2)$, $O(CH_2)_2-O(CH_2)_2-N(R_1)(R_2)$, $OCH_2C(=O)-N(R_1)(R_2)$, $OCH_2C(=O)-N(R_3)-(CH_2)_2-N(R_1)(R_2)$, and $O(CH_2)_2-N(R_3)-C(=NR_4)[N(R_1)(R_2)]$; wherein $R_1$, $R_2$, $R_3$ and $R_4$ are each, independently, H or $C_1-C_6$ alkyl.

Embodiment 119

The conjugated antisense compound of embodiment 116, wherein each 2' substituent is independently selected from among: a halogen, $OCH_3$, $OCF_3$, $OCH_2CH_3$, $OCH_2CF_3$, $OCH_2-CH=CH_2$, $O(CH_2)_2-OCH_3$ (MOE), $O(CH_2)_2-O(CH_2)_2-N(CH_3)_2$, $OCH_2C(=O)-N(H)CH_3$, $OCH_2C(=O)-N(H)-(CH_2)_2-N(CH_3)_2$, and $OCH_2-N(H)-C(=NH)NH_2$.

Embodiment 120

The conjugated antisense compound of embodiment 116, wherein the at least one 2'-modified nucleoside comprises a 2'-MOE sugar moiety.

Embodiment 121

The conjugated antisense compound of embodiment 116, wherein the at least one 2'-modified nucleoside comprises a 2'-OMe sugar moiety.

Embodiment 122

The conjugated antisense compound of embodiment 116, wherein the at least one 2'-modified nucleoside comprises a 2'-F sugar moiety.

Embodiment 123

The conjugated antisense compound of any of embodiments 1-122, wherein the antisense oligonucleotide comprises at least one modified nucleoside comprising a sugar surrogate.

Embodiment 124

The conjugated antisense compound of embodiment 123, wherein the modified nucleoside comprises an F-HNA sugar moiety.

Embodiment 125

The conjugated antisense compound of embodiment 123, wherein the modified nucleoside comprises an HNA sugar moiety.

Embodiment 126

The conjugated antisense compound of any of embodiments 1-125 wherein the antisense oligonucleotide comprises at least one modified nucleoside comprising a bicyclic sugar moiety.

Embodiment 127

The conjugated antisense compound of embodiment 126, wherein the bicyclic sugar moiety is a cEt sugar moiety.

Embodiment 128

The conjugated antisense compound of embodiment 126, wherein bicyclic sugar moiety is an LNA sugar moiety.

Embodiment 129

The conjugated antisense compound of any of embodiments 1-128, wherein the antisense oligonucleotide comprises at least one modified internucleoside linkage.

Embodiment 130

The conjugated antisense compound of embodiment 129, wherein each internucleoside linkage of the antisense oligonucleotide is a modified internucleoside linkage.

Embodiment 131

The conjugated antisense compound of embodiment 129, wherein the antisense oligonucleotide comprises at least one modified linkage and at least one unmodified phosphodiester internucleoside linkage.

Embodiment 132

The conjugated antisense compound of any of embodiments 129-131 wherein at least one modified internucleoside linkage is a phosphosphorothioate internucleoside linkage.

Embodiment 133

The conjugated antisense compound of any of embodiments 129-122, wherein each modified internucleoside linkage is a phosphorothioate internucleoside linkage.

Embodiment 134

The conjugated antisense compound of any of embodiments 129-133, wherein the antisense oligonucleotide comprises at least 2 phosphodiester internucleoside linkages.

Embodiment 135

The conjugated antisense compound of any of embodiments 129-133, wherein the antisense oligonucleotide comprises at least 3 phosphodiester internucleoside linkages.

Embodiment 136

The conjugated antisense compound of any of embodiments 129-132, wherein the antisense oligonucleotide comprises at least 4 phosphodiester internucleoside linkages.

Embodiment 137

The conjugated antisense compound of any of embodiments 129-132, wherein the antisense oligonucleotide comprises at least 5 phosphodiester internucleoside linkages.

Embodiment 138

The conjugated antisense compound of any of embodiments 129-132, wherein the antisense oligonucleotide comprises at least 6 phosphodiester internucleoside linkages.

Embodiment 139

The conjugated antisense compound of any of embodiments 129-132, wherein the antisense oligonucleotide comprises at least 7 phosphodiester internucleoside linkages.

Embodiment 140

The conjugated antisense compound of any of embodiments 129-132, wherein the antisense oligonucleotide comprises at least 8 phosphodiester internucleoside linkages.

Embodiment 141

The conjugated antisense compound of any of embodiments 129-132, wherein the antisense oligonucleotide comprises at least 9 phosphodiester internucleoside linkages.

Embodiment 142

The conjugated antisense compound of any of embodiments 129-132, wherein the antisense oligonucleotide comprises at least 10 phosphodiester internucleoside linkages.

Embodiment 143

The conjugated antisense compound of any of embodiments 129-142, wherein the antisense oligonucleotide comprises fewer than 16 phosphorothioate internucleoside linkages.

Embodiment 144

The conjugated antisense compound of any of embodiments 129-142, wherein the antisense oligonucleotide comprises fewer than 15 phosphorothioate internucleoside linkages.

Embodiment 145

The conjugated antisense compound of any of embodiments 129-142, wherein the antisense oligonucleotide comprises fewer than 14 phosphorothioate internucleoside linkages.

Embodiment 146

The conjugated antisense compound of any of embodiments 129-142, wherein the antisense oligonucleotide comprises fewer than 13 phosphorothioate internucleoside linkages.

Embodiment 147

The conjugated antisense compound of any of embodiments 129-142, wherein the antisense oligonucleotide comprises fewer than 12 phosphorothioate internucleoside linkages.

Embodiment 148

The conjugated antisense compound of any of embodiments 129-142, wherein the antisense oligonucleotide comprises fewer than 11 phosphorothioate internucleoside linkages.

Embodiment 149

The conjugated antisense compound of any of embodiments 129-142, wherein the antisense oligonucleotide comprises fewer than 10 phosphorothioate internucleoside linkages.

Embodiment 150

The conjugated antisense compound of any of embodiments 129-142, wherein the antisense oligonucleotide comprises fewer than 9 phosphorothioate internucleoside linkages.

Embodiment 151

The conjugated antisense compound of any of embodiments 129-142, wherein the antisense oligonucleotide comprises fewer than 8 phosphorothioate internucleoside linkages.

Embodiment 152

The conjugated antisense compound of any of embodiments 129-142, wherein the antisense oligonucleotide comprises fewer than 7 phosphorothioate internucleoside linkages.

Embodiment 153

The conjugated antisense compound of any of embodiments 129-142, wherein the antisense oligonucleotide comprises fewer than 6 phosphorothioate internucleoside linkages.

Embodiment 154

The conjugated antisense compound of any of embodiments 129-153, wherein each terminal internucleoside linkage of the antisense oligonucleotide is a phosphorothioate internucleoside linkage.

Embodiment 155

The conjugated antisense compound of any of embodiments 129-154, wherein each internucleoside linkage linking two deoxynucleosides of the antisense oligonucleotide is a phosphorothioate internucleoside linkage.

Embodiment 156

The conjugated antisense compound of any of embodiments 129-155, wherein each non-terminal internucleoside linkage linking two modified nucleosides of the antisense oligonucleotide is a phosphodiester internucleoside linkage.

Embodiment 157

The conjugated antisense compound of any of embodiments 129-156, wherein each non-terminal internucleoside linkage of the antisense oligonucleotide that is 3' of a modified nucleoside is a phosphodiester internucleoside linkage.

Embodiment 158

The conjugated antisense compound of any of embodiments 129-157, wherein each internucleoside linkage of the antisense oligonucleotide that is 3' of a deoxynucleoside is a phosphorothioate internucleoside linkage.

Embodiment 159

The conjugated antisense compound of any of embodiments 1-158 wherein the antisense oligonucleotides has a chemical motif selected from among:
MsMy(Ds)$_{0-1}$(DsDs)$_{(3-5)}$MsM
MsMy(Ds)$_{0-1}$(DsDs)$_{(3-5)}$MyMsM
MsMy(Ds)$_{0-1}$(DsDs)$_{(3-5)}$MyMyMsM
MsMy(Ds)$_{0-1}$(DsDs)$_{(3-5)}$MyMyMyMsM
MsMyMy(Ds)$_{0-1}$(DsDs)$_{(3-5)}$MsM
MsMyMy(Ds)$_{0-1}$(DsDs)$_{(3-5)}$MyMsM
MsMyMy(Ds)$_{0-1}$(DsDs)$_{(3-5)}$MyMyMsM
MsMyMy(Ds)$_{0-1}$(DsDs)$_{(3-5)}$MyMyMyMsM
MsMyMyMy(Ds)$_{0-1}$(DsDs)$_{(3-5)}$MsM
MsMyMyMy(Ds)$_{0-1}$(DsDs)$_{(3-5)}$MyMsM
MsMyMyMy(Ds)$_{0-1}$(DsDs)$_{(3-5)}$MyMyMsM
MsMyMyMy(Ds)$_{0-1}$(DsDs)$_{(3-5)}$MyMyMyMsM
MsMyMyMyMy(Ds)$_{0-1}$(DsDs)$_{(3-5)}$MsM
MsMyMyMyMy(Ds)$_{0-1}$(DsDs)$_{(3-5)}$MyMsM
MsMyMyMyMy(Ds)$_{0-1}$(DsDs)$_{(3-5)}$MyMyMsM; and
MsMyMyMyMy(Ds)$_{0-1}$(DsDs)$_{(3-5)}$MyMyMyMsM;
wherein each M is independently a modified nucleoside, each D is a deoxynucleoside; each s is a phosphorothioate internucleoside linkage, and each y is either a phosphodiester internucleoside linkage or a phosphorothioate internucleoside linkage, provided that at least one y is a phosphodiester internucleotide linkage.

Embodiment 160

The conjugated antisense compound of any of embodiments 1-158 wherein the antisense oligonucleotides has a chemical motif selected from among:
MsMo(Ds)$_{0-1}$(DsDs)$_{(3-5)}$MoMsM
MsMo(Ds)$_{0-1}$(DsDs)$_{(3-5)}$MoMoMsM
MsMo(Ds)$_{0-1}$(DsDs)$_{(3-5)}$MoMoMoMsM
MsMoMo(Ds)$_{0-1}$(DsDs)$_{(3-5)}$MsM
MsMoMo(Ds)$_{0-1}$(DsDs)$_{(3-5)}$MoMsM
MsMoMo(Ds)$_{0-1}$(DsDs)$_{(3-5)}$MoMoMsM
MsMoMo(Ds)$_{0-1}$(DsDs)$_{(3-5)}$MoMoMoMsM
MsMoMoMo(Ds)$_{0-1}$(DsDs)$_{(3-5)}$MsM
MsMoMoMo(Ds)$_{0-1}$(DsDs)$_{(3-5)}$MoMsM
MsMoMoMo(Ds)$_{0-1}$(DsDs)$_{(3-5)}$MoMoMsM
MsMoMoMo(Ds)$_{0-1}$(DsDs)$_{(3-5)}$MoMoMoMsM
MsMoMoMoMo(Ds)$_{0-1}$(DsDs)$_{(3-5)}$MsM
MsMoMoMoMo(Ds)$_{0-1}$(DsDs)$_{(3-5)}$MoMsM
MsMoMoMoMo(Ds)$_{0-1}$(DsDs)$_{(3-5)}$MoMoMsM; and
MsMoMoMoMo(Ds)$_{0-1}$(DsDs)$_{(3-5)}$MoMoMoMsM;

wherein each M is independently a modified nucleoside, each D is a deoxynucleoside; each o is a phosphodiester internucleoside linkage, and each s is a phosphorothioate internucleoside linkage.

Embodiment 161

The conjugated antisense compound of embodiment 159 or 160, wherein each M is independently selected from among: a 2'-MOE nucleoside and a bicyclic nucleoside.

Embodiment 162

The conjugated antisense compound of embodiment 161, wherein each M is independently selected from among a 2'-MOE nucleoside, a cEt nucleoside, and an LNA nucleoside.

Embodiment 163

The conjugated antisense compound of embodiment 159 or 160, wherein each M is a 2'-MOE nucleoside.

Embodiment 164

The conjugated antisense compound of embodiment 159 or 160, wherein each M is a cEt nucleoside.

Embodiment 165

The conjugated antisense compound of embodiments 159 or 160, wherein each M is an LNA nucleoside.

Embodiment 166

The conjugated antisense compound of any of embodiments 1-165, wherein the antisense oligonucleotide has a nucleobase sequence comprising an at least 8 nucleobase portion complementary to an equal length portion of a target nucleic acid.

Embodiment 167

The conjugated antisense compound of any of embodiments 1-165, wherein the antisense oligonucleotide has a nucleobase sequence comprising an at least 10 nucleobase portion complementary to an equal length portion of a target nucleic acid.

Embodiment 168

The conjugated antisense compound of any of embodiments 1-165, wherein the antisense oligonucleotide has a nucleobase sequence comprising an at least 12 nucleobase portion complementary to an equal length portion of a target nucleic acid.

Embodiment 169

The conjugated antisense compound of any of embodiments 1-165, wherein the antisense oligonucleotide has a nucleobase sequence comprising an at least 14 nucleobase portion complementary to an equal length portion of a target nucleic acid.

Embodiment 170

The conjugated antisense compound of any of embodiments 1-165, wherein the antisense oligonucleotide has a nucleobase sequence comprising an at least 16 nucleobase portion complementary to an equal length portion of a target nucleic acid.

Embodiment 171

The conjugated antisense compound of any of embodiments 1-165, wherein the antisense oligonucleotide has a nucleobase sequence comprising an at least 18 nucleobase portion complementary to an equal length portion of a target nucleic acid.

Embodiment 172

The conjugated antisense compound of any of embodiments 1-171, wherein the antisense oligonucleotide is at least 90% complementary to a target nucleic acid.

Embodiment 173

The conjugated antisense compound of any of embodiments 1-171, wherein the antisense oligonucleotide is at least 95% complementary to a target nucleic acid.

Embodiment 174

The conjugated antisense compound of any of embodiments 1-171, wherein the antisense oligonucleotide is 100% complementary to a target nucleic acid.

Embodiment 175

The conjugated antisense compound of any of embodiments 166-174, wherein the target nucleic acid is a pre-mRNA.

Embodiment 176

The conjugated antisense compound of any of embodiments 166-174, wherein the target nucleic acid is an mRNA.

Embodiment 177

The conjugated antisense compound of any of embodiments 166-176, wherein the target nucleic acid is expressed in the liver.

Embodiment 178

The conjugated antisense compound of embodiment 177, wherein the target nucleic acid is expressed in hepatocytes.

Embodiment 179

The conjugated antisense compound of embodiment 177 or 178, wherein the target nucleic encodes a protein selected from among: Androgen Receptor, Apolipoprotein (a), Apolipoprotein B, Apolipoprotein C-III, C-Reactive Protein, eIF-4E, Factor VII, Factor XI, Glucocorticoid Receptor, Glucagon Receptor, Protein Tyrosine Phosphatase 1B, STAT3, and Transthyretin.

Embodiment 180

The conjugated antisense compound of embodiment 166-179 wherein the target nucleic acid is a viral nucleic acid.

Embodiment 181

The conjugated antisense compound of embodiment 180, wherein the viral nucleic acid expressed in the liver.

Embodiment 182

The conjugated antisense compound of embodiment 181, wherein the target nucleic acid is a Hepatitis B viral nucleic acid.

Embodiment 183

The conjugated antisense compound of any of embodiments 1-179, wherein the antisense oligonucleotide comprises the nucleobase sequence of any one of SEQ ID NOs.: 17, 18, 19, 20, 21, 22, 23, or 24.

Embodiment 184

The conjugated antisense compound of any of embodiments 1-179, wherein the antisense oligonucleotide comprises the nucleobase sequence of any one of SEQ ID NO.: 25, 26, 27, 28, 29, or 30.

Embodiment 185

The conjugated antisense compound of any of embodiments 1-179, wherein the antisense oligonucleotide comprises the nucleobase sequence of SEQ ID NO.: 31.

Embodiment 186

The conjugated antisense compound of any of embodiments 1-179, wherein the antisense oligonucleotide comprises the nucleobase sequence of SEQ ID NO.: 32.

Embodiment 187

The conjugated antisense compound of any of embodiments 1-179, wherein the antisense oligonucleotide comprises the nucleobase sequence of SEQ ID NO.: 33.

Embodiment 188

The conjugated antisense compound of any of embodiments 1-179, wherein the antisense oligonucleotide comprises the nucleobase sequence of SEQ ID NO.: 34.

Embodiment 189

The conjugated antisense compound of any of embodiments 1-179, wherein the antisense oligonucleotide comprises the nucleobase sequence of any of SEQ ID NOs.: 35, 36, 37, 38, 39, 40, 41, 42, or 43.

Embodiment 190

The conjugated antisense compound of any of embodiments 1-179, wherein the antisense oligonucleotide comprises the nucleobase sequence of SEQ ID NO.: 44, 45, 46, 47, or 48.

Embodiment 191

The conjugated antisense compound of any of embodiments 1-179, wherein the antisense oligonucleotide comprises the nucleobase sequence of any of SEQ ID NOs.: 49, 50, 51, 52, 53, 54, 55, 56, 57, 58, or 59.

Embodiment 192

The conjugated antisense compound of any of embodiments 1-179, wherein the antisense oligonucleotide comprises the nucleobase sequence of any of SEQ ID NOs.: 60, 61, 62, 63, 64, 65, 66, or 67.

Embodiment 193

The conjugated antisense compound of any of embodiments 1-179, wherein the antisense oligonucleotide comprises the nucleobase sequence of any of SEQ ID NO.: 69, 70, 71, or 72.

Embodiment 194

The conjugated antisense compound of any of embodiments 1-179, wherein the antisense oligonucleotide comprises the nucleobase sequence of SEQ ID NO.: 73.

Embodiment 195

The conjugated antisense compound of any of embodiments 1-179, wherein the antisense oligonucleotide comprises the nucleobase sequence of any of SEQ ID NOs.: 74, 75, 76, 77, 78, 79, 80, or 81.

Embodiment 196

The conjugated antisense compound of any of embodiments 1-179, wherein the antisense oligonucleotide comprises the nucleobase sequence of SEQ ID NO.: 68.

Embodiment 197

The conjugated antisense compound of any of embodiments 1-179, wherein the antisense oligonucleotide comprises the nucleobase sequence of any of SEQ ID NOs.: 82-103.

Embodiment 198

A method of reducing the amount or activity of a target nucleic acid in a cell, comprising contacting a cell with the conjugated antisense compound of any of embodiments 1-197.

Embodiment 199

The method of embodiment 198, wherein the cell is a liver cell.

Embodiment 200

The method of embodiment 199, wherein the cell is a hepatocyte.

Embodiment 201

The method of any of embodiments 198-200 wherein the cell is in vitro.

Embodiment 202

The method of any of embodiments 198-200 wherein the cell is in an animal.

Embodiment 203

The method of embodiment 202 wherein the animal is a mouse.

Embodiment 204

The method of embodiment 202 wherein the animal is a human.

Embodiment 205

A pharmaceutical composition comprising an conjugated antisense compound according to any of embodiments 1-197 and a pharmaceutically acceptable carrier or diluent.

Embodiment 206

The pharmaceutical composition of embodiment 205 wherein the pharmaceutically acceptable carrier or diluent is selected from among sterile water and sterile saline.

Embodiment 207

A method of treating a disease or condition in an animal comprising administering the pharmaceutical composition of embodiment 205 or 206 to the animal and thereby treating the disease or condition in the animal.

Embodiment 208

The method of embodiment 207 wherein the animal is a mouse.

Embodiment 209

The method of embodiment 207 wherein the animal is a human.

Embodiment 210

The method of any of embodiments 207-209, wherein the disease or condition is a liver disease or condition.

Embodiment 211

The method of any of embodiments 207-210 wherein the administration is parenteral.

Embodiment 212

The method embodiment 211 wherein the administration is by subcutaneous injection.

Embodiment 213

The method of embodiment 211 wherein the administration is by intravenous injection.

Embodiment 214

The method of embodiment 211 wherein the administration is by intramuscular injection.

Embodiment 215

The method of any of embodiments 207-214 wherein the conjugated antisense compound is provided at a dose of 1-10 mg/kg.

Embodiment 216

The method of any of embodiments 207-214 wherein the conjugated antisense compound is provided at a dose of less than 1 mg/kg.

Embodiment 217

The method of any of embodiments 207-216 wherein the conjugated antisense compound is provided at a dose of greater than 10 mg/kg.

Embodiment 218

The method of any of embodiments 207-217 wherein the conjugated antisense compound is provided for a dosing period of at least 2 months.

Embodiment 219

The method of any of embodiments 207-217 wherein the conjugated antisense compound is provided for a dosing period of at least 4 months.

Embodiment 220

The method of any of embodiments 207-217 wherein the conjugated antisense compound is provided for a dosing period of at least 6 months.

Embodiment 221

The method of any of embodiments 207-217 wherein the conjugated antisense compound is provided at a dosing frequency of about one dose every week.

Embodiment 222

The method of any of embodiments 207-217 wherein the conjugated antisense compound is provided at a dosing frequency of about one dose every two weeks.

Embodiment 223

The method of any of embodiments 207-217 wherein the conjugated antisense compound is provided at a dosing frequency of about one dose every three weeks.

Embodiment 224

The method of any of embodiments 207-217 wherein the conjugated antisense compound is provided at a dosing frequency of one dose every four weeks.

Embodiment 225

The method of any of embodiments 207-217 wherein the conjugated antisense compound is provided at a dosing frequency of one dose every five weeks.

Embodiment 226

The method of any of embodiments 207-217 wherein the conjugated antisense compound is provided at a dosing frequency of one dose every six weeks.

Embodiment 227

The method of any of embodiments 207-217 wherein the conjugated antisense compound is provided at a dosing frequency of one dose every seven weeks.

Embodiment 228

The method of any of embodiments 207-217 wherein the conjugated antisense compound is provided at a dosing frequency of one dose every eight weeks.

Embodiment 229

A conjugated antisense compound comprising: an antisense oligonucleotide comprising 12-30 linked nucleosides, and a conjugate group, wherein the conjugate group comprises at least one cell-targeting moiety.

Embodiment 230

The conjugated antisense compound of embodiment 229, wherein the conjugate group comprises 2 cell-targeting moieties.

Embodiment 231

The conjugated antisense compound of embodiment 229, wherein the conjugate group comprises 3 cell-targeting moieties.

Embodiment 232

The conjugated antisense compound of embodiment 229, wherein the conjugate group comprises 4 cell-targeting moieties.

Embodiment 233

The conjugated antisense compound of any of embodiments 229-232, wherein each cell-targeting moiety comprises a cleavable bond.

Embodiment 234

The conjugated antisense compound of any of embodiments 229-233, wherein each cell-targeting moiety comprises a tether and a ligand.

Embodiment 235

The conjugated antisense compound of embodiment 234, wherein the ligand is a cell surface receptor ligand.

Embodiment 236

The conjugated antisense compound of embodiment 235, wherein at least one tether comprises a cleavable bond.

Embodiment 237

The conjugated antisense compound of embodiment 235, wherein each tether comprises a cleavable bond.

Embodiment 238

The conjugated antisense compound of any of embodiments 229-237, wherein the conjugate group comprises a conjugate linker.

Embodiment 239

The conjugated antisense compound of embodiment 238, wherein the conjugate linker comprises one or more cleavable bonds.

Embodiment 240

The conjugated antisense compound of any of embodiments 229-239, wherein the conjugate group comprises a branching group.

Embodiment 241

The conjugated antisense compound of embodiment 240, wherein the branching group comprises one or more cleavable bonds.

Embodiment 242

The conjugated antisense compound of any of embodiments 229-241, wherein the conjugate group comprises a cleavable moiety.

Embodiment 243

The conjugated antisense compound of embodiment 242, wherein the cleavable moiety comprises one or more cleavable bonds.

Embodiment 244

The conjugated antisense compound of any of embodiments 229-243, wherein the conjugate group comprises at least one cleavable bond.

Embodiment 245

The conjugated antisense compound of any of embodiments 229-243, wherein the conjugate group comprises at least two cleavable bonds.

Embodiment 246

The conjugated antisense compound of any of embodiments 229-243, wherein the conjugate group comprises at least 3 cleavable bonds.

Embodiment 247

The conjugated antisense compound of any of embodiments 229-243, wherein the conjugate group comprises at least 4 cleavable bonds.

Embodiment 248

The conjugated antisense compound of any of embodiments 229-243, wherein the conjugate group comprises at least 5 cleavable bonds.

Embodiment 249

The conjugated antisense compound of any of embodiments 229-248, comprising a cleavable bond selected from among an amide, a polyamide, an ester, an ether, a phosphodiester, a phosphate ester, a carbamate, a di-sulfide, or a peptide.

Embodiment 250

The conjugated antisense compound of embodiment 249, wherein the peptide is a di-peptide.

Embodiment 251

The conjugated antisense compound of embodiment 249, wherein the peptide is a tri-peptide.

Embodiment 252

The conjugated antisense compound of embodiment 249, wherein the peptide is lysine.

Embodiment 253

The conjugated antisense compound of embodiment 249, wherein the peptide is a lysine derivative.

Embodiment 254

The conjugated antisense compound of any of embodiments 250-251, wherein one or more peptides are lysine.

Embodiment 255

The conjugated antisense compound of any of embodiments 250-251, wherein two or more peptides are lysine.

Embodiment 256

The conjugated antisense compound of any of embodiments 229 to 255 wherein the conjugate group comprises:

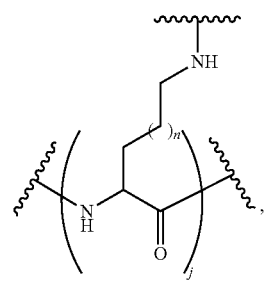

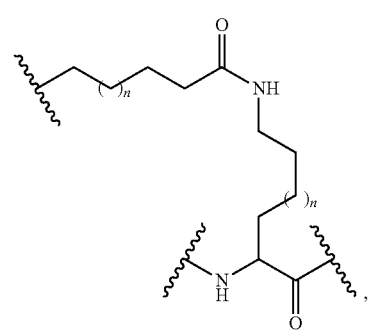

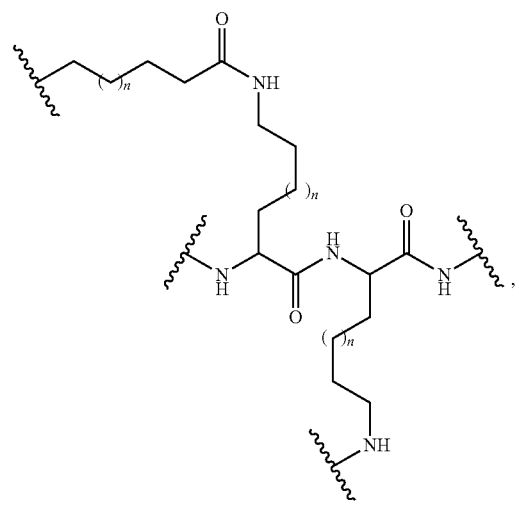

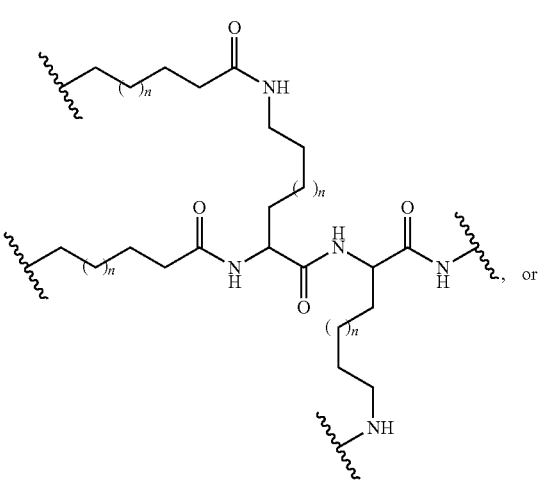, or

-continued
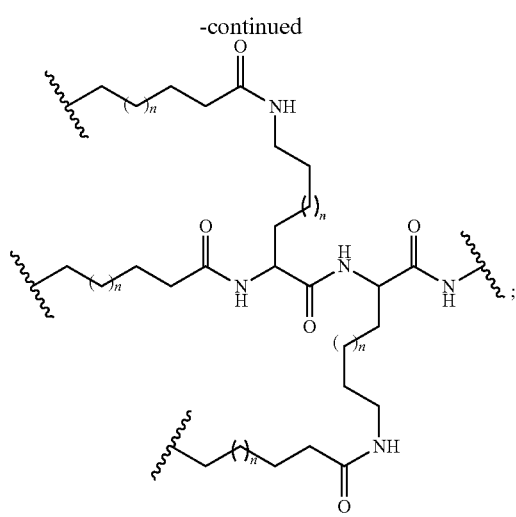
wherein each j is an integer from 1 to 3; and
wherein each n is an integer from 1 to 20.
Embodiment 257
The conjugated antisense compound of any of embodiments 229 to 255 wherein the conjugate group comprises:
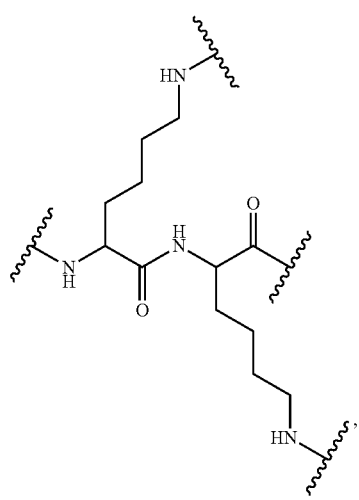
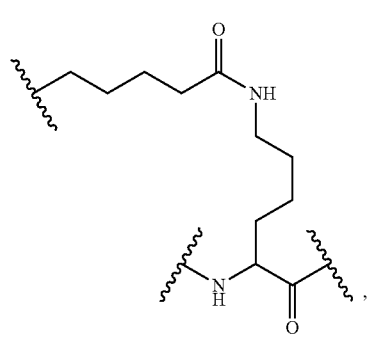
-continued
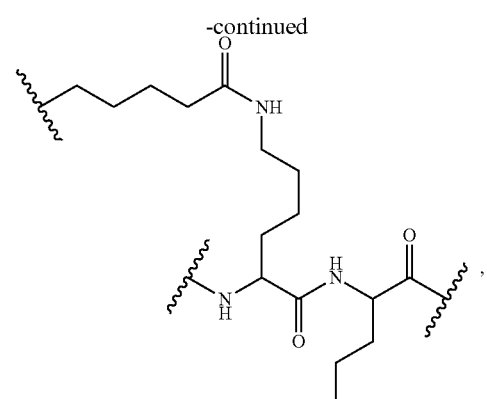
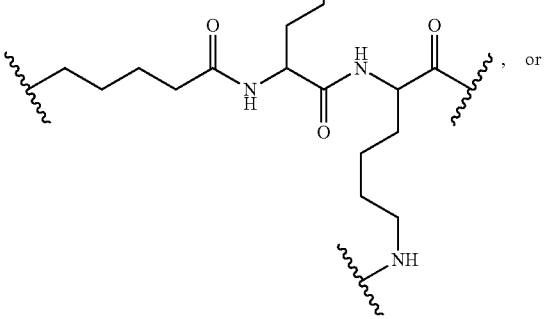
Embodiment 258
The conjugated antisense compound of any of embodiments 229 to 257 wherein the branching group comprises:

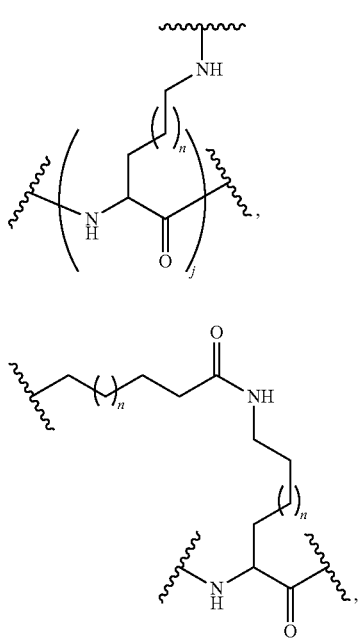
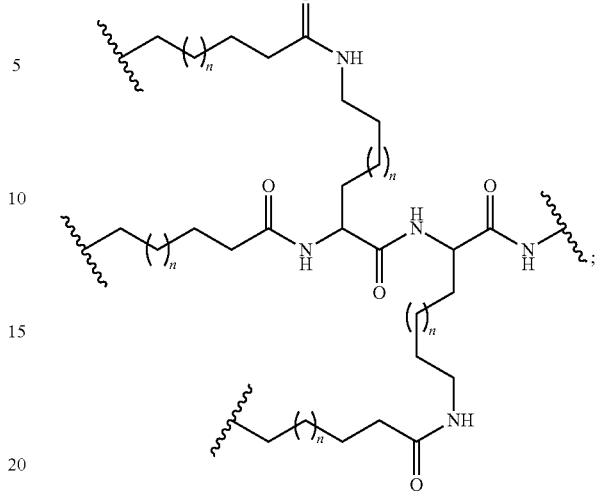
wherein each j is an integer from 1 to 3; and
wherein each n is an integer from 1 to 20.
Embodiment 259
The conjugated antisense compound of any of embodiments 229 to 257 wherein the branching group comprises:
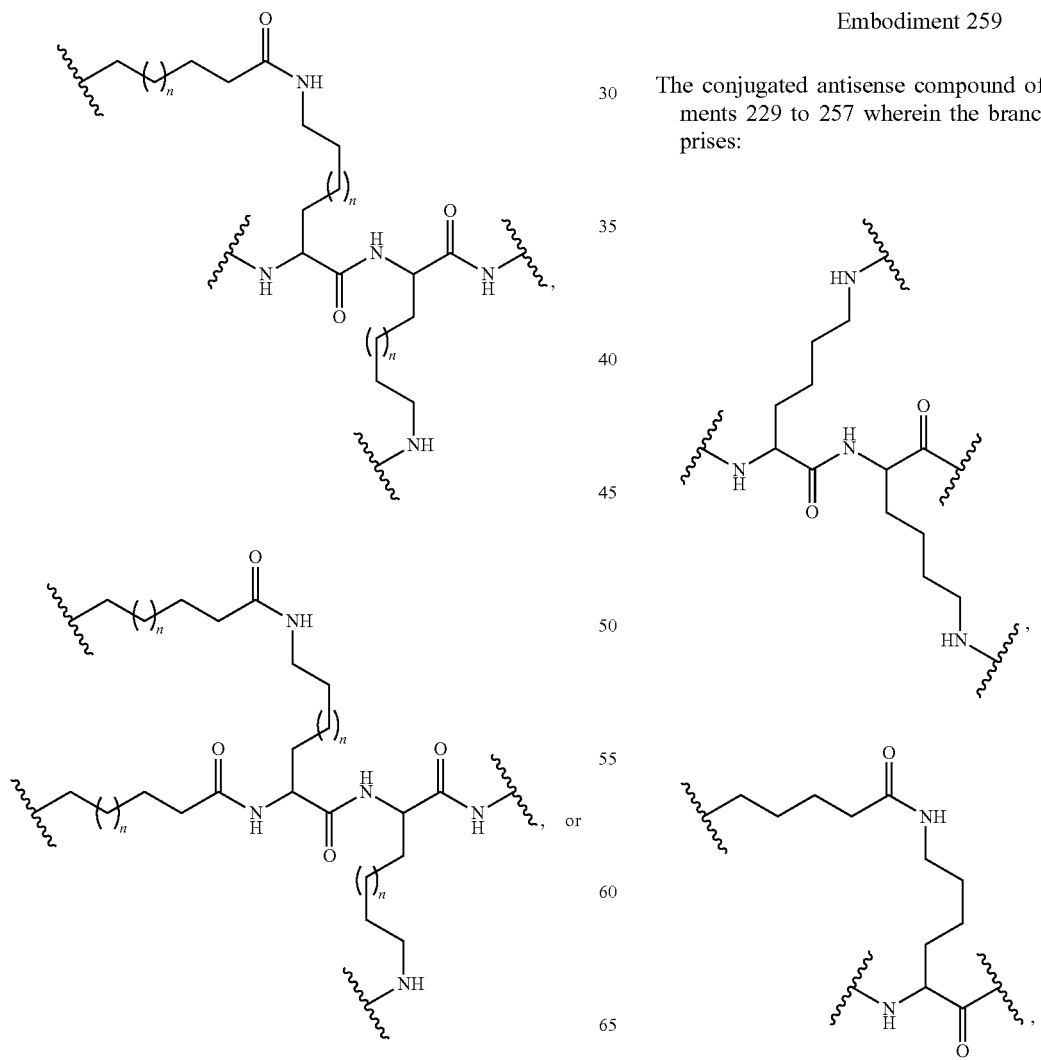

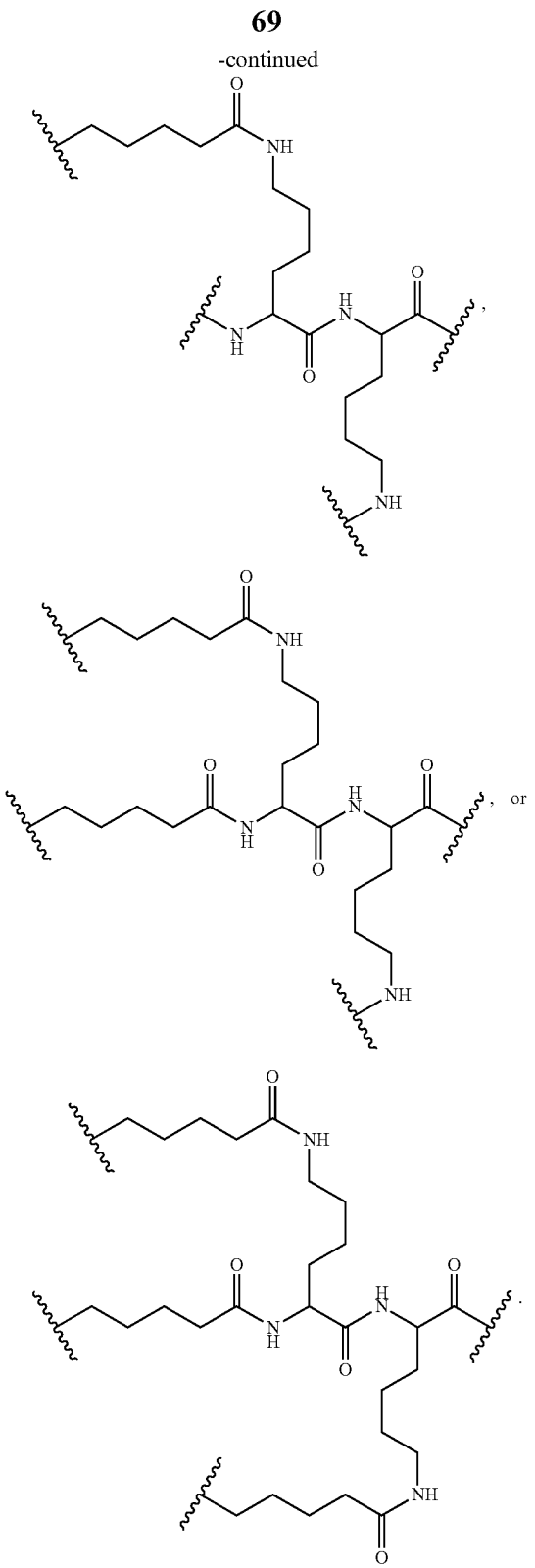

Embodiment 260

The conjugated antisense compound of any of embodiments 229-259, wherein the cell-targeting moiety comprises a carbohydrate.

Embodiment 261

The conjugated antisense compound of any of embodiments 229-259, wherein the cell-targeting moiety comprises a carbohydrate cluster.

Embodiment 262

The conjugated antisense compound of any of embodiments 229-259, wherein the cell-targeting moiety comprises a cell surface receptor ligand.

Embodiment 263

The conjugated antisense compound of any of embodiments 229-259, wherein the cell-targeting moiety comprises at least one N-Acetylgalactosamine (GalNAc).

Embodiment 264

The conjugated antisense compound of any of embodiments 229-263, wherein:
the cleavable moiety is covalently bound to the antisense oligonucleotide;
the conjugate linker is covalently bound to the cleavable moiety; and
the cell-targeting moiety is covalently bound to the conjugate linker.

Embodiment 265

The conjugated antisense compound of any of embodiments 229-264, wherein the cell-targeting moiety comprises a branching group.

Embodiment 266

The conjugated antisense compound of embodiment 265, wherein the branching group is covalently attached to the conjugate linker.

Embodiment 267

The conjugated antisense compound of any of embodiments 229-266, wherein the cell-targeting moiety comprises at least one tether.

Embodiment 268

The conjugated antisense compound any of embodiments 229-267, wherein the at least one tether is covalently attached to the branching group.

Embodiment 269

The conjugated antisense compound of any of embodiments 229-267, wherein the cell-targeting moiety comprises at least one ligand.

Embodiment 270

The conjugated antisense compound of embodiment 269, wherein each of the at least one ligand is covalently attached to a tether.

Embodiment 271

The conjugated antisense compound of any of embodiments 229-270, wherein the compound has a structure represented by formula I below:

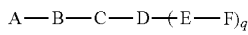

wherein
A is the antisense oligonucleotide;
B is the cleavable moiety
C is the conjugate linker
D is the branching group
each E is a tether;
each F is a ligand; and
q is an integer between 1 and 5.

Embodiment 272

The conjugated antisense compound any of embodiments 229-271, wherein the cleavable moiety comprises 1-4 linked cleavable moiety nucleosides, wherein the linkage between the antisense oligonucleotide and the first cleavable moiety nucleoside is a phosphodiester internucleoside linkage.

Embodiment 273

The conjugated antisense compound of embodiment 272, wherein each internucleoside linkage between each of the linked cleavable moiety nucleosides is a phosphodiester internucleoside linkage.

Embodiment 274

The conjugated antisense compound of embodiment 271 or 272, wherein the cleavable moiety comprises 1-3 linked cleavable moiety nucleosides.

Embodiment 275

The conjugated antisense compound of embodiment 271 or 272, wherein the cleavable moiety comprises 1-2 linked cleavable moiety nucleosides.

Embodiment 276

The conjugated antisense compound of embodiment 271, wherein the cleavable moiety comprises one cleavable moiety nucleoside.

Embodiment 277

The conjugated antisense compound of any of embodiments 229 to 276, wherein the cleavable moiety is a cleavable moiety nucleoside selected from the group consisting of a purine, a substituted purine, a pyrimidine, or a substituted pyrimidine.

Embodiment 278

The conjugated antisense compound of any of embodiments 229 to 276, wherein the cleavable moiety is a cleavable moiety nucleoside selected from cytidine, uridine, adenosine, thymidine, and guanosine.

Embodiment 279

The conjugated antisense compound of any of embodiments 229 to 276, wherein the cleavable moiety is a cleavable moiety deoxynucleoside selected from deoxyadenosine, deoxyguanosine, deoxyinosine, thymidine, deoxyuridine, and deoxycytidine.

Embodiment 280

The conjugated antisense compound of any of embodiments 229 to 280, wherein the cleavable moiety comprises deoxyadenosine.

Embodiment 281

The conjugated antisense compound of any of embodiments 229 to 280, wherein the cleavable moiety is deoxyadenosine.

Embodiment 282

The conjugated antisense compound of any of embodiments 229 to 276, wherein the cleavable moiety has a structure selected from among:

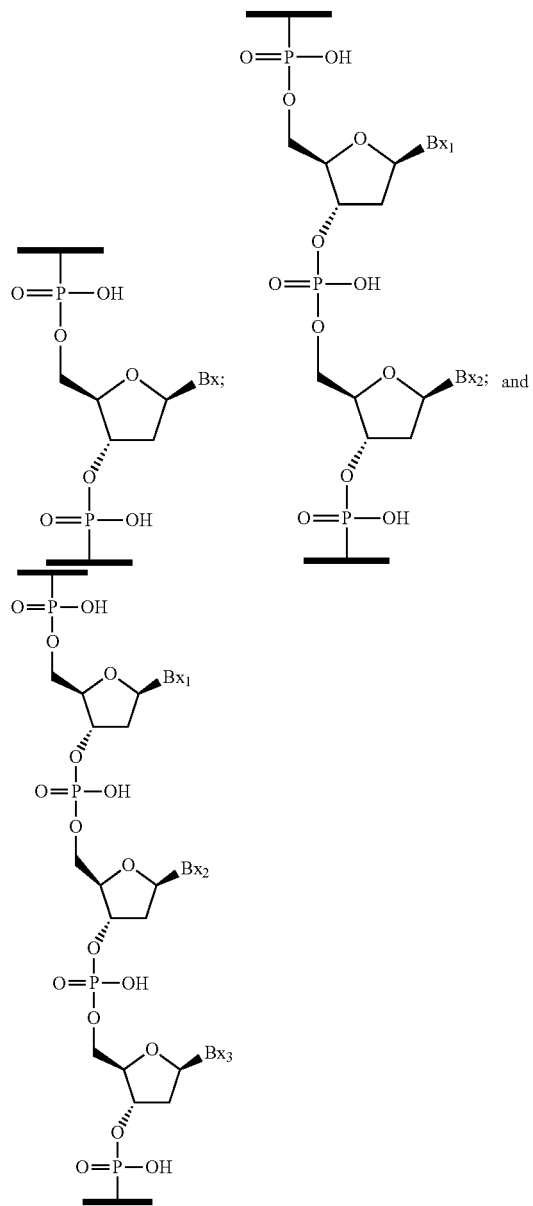

wherein each of Bx, Bx$_1$, Bx$_2$, and Bx$_3$ is independently a heterocyclic base moiety.

Embodiment 283

The conjugated antisense compound of embodiment 282, wherein the heterocyclic base moiety is selected from among: uracil, thymine, cytosine, 5-methylcytosine, adenine or guanine.

Embodiment 284

The conjugated antisense compound of any of embodiments 229 to 276, wherein the cleavable moiety has the structure:

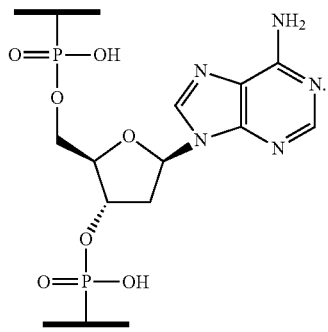

Embodiment 285

The conjugated antisense compound of any of embodiments 229 to 285, wherein the conjugate linker comprises a pyrrolidine.

Embodiment 286

The conjugated antisense compound of any of embodiments 229 to 286, wherein the conjugate linker comprises PEG.

Embodiment 287

The conjugated antisense compound of any of embodiments 229 to 287, wherein the conjugate linker comprises an amide.

Embodiment 288

The conjugated antisense compound of any of embodiments 229 to 288, wherein the conjugate linker comprises a polyamide.

Embodiment 289

The conjugated antisense compound of any of embodiments 229 to 289, wherein the conjugate linker comprises an amine Embodiment 290

The conjugated antisense compound of any of embodiments 229 to 290, wherein the conjugate linker comprises one or more disulfide bonds.

Embodiment 291

The conjugated antisense compound of any of embodiments 229 to 291, wherein the conjugate linker comprises a protein binding moiety.

Embodiment 292

The conjugated antisense compound of embodiment 292, wherein the protein binding moiety comprises a lipid.

Embodiment 293

The conjugated antisense compound of embodiment 293, wherein the protein binding moiety is selected from among: cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid.

Embodiment 294

The conjugated antisense compound of any of embodiments 229 to 293 wherein the protein binding moiety is a C16 to C22 long chain saturated or unsaturated fatty acid, cholesterol, cholic acid, vitamin E, adamantane or 1-pentafluoropropyl.

Embodiment 295

The conjugated antisense compound of any of embodiments 229 to 294 wherein the conjugate linker has a structure selected from among:

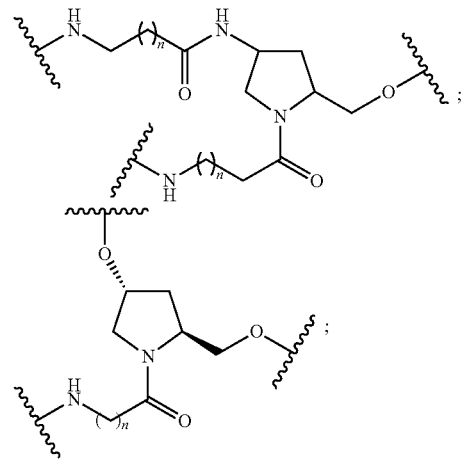

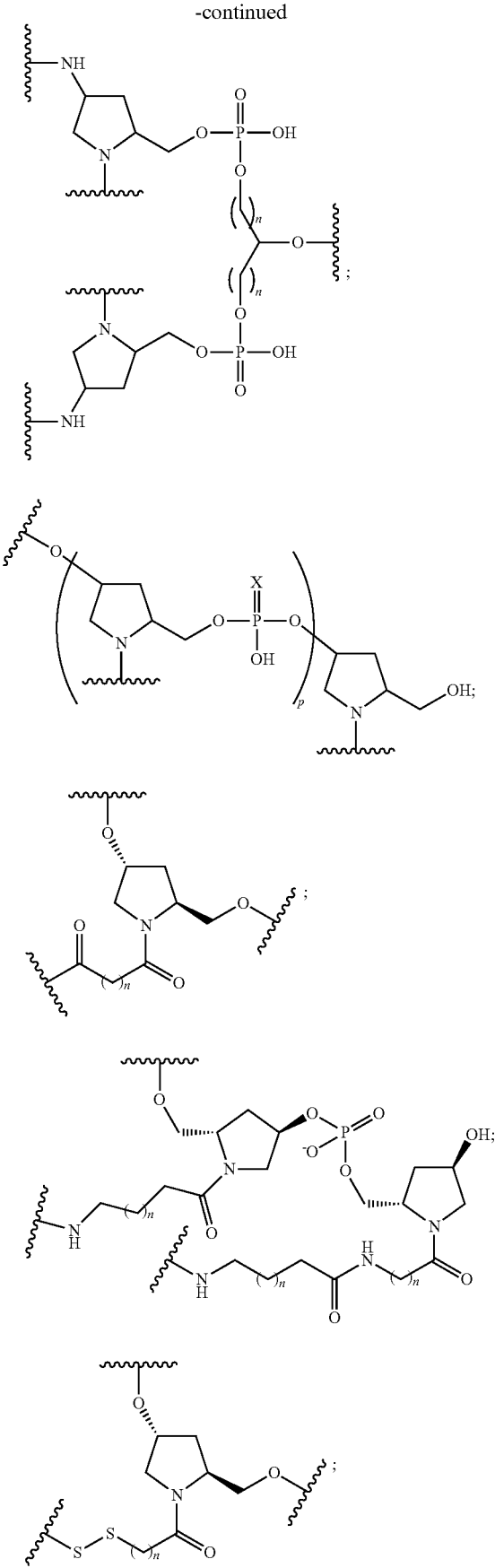
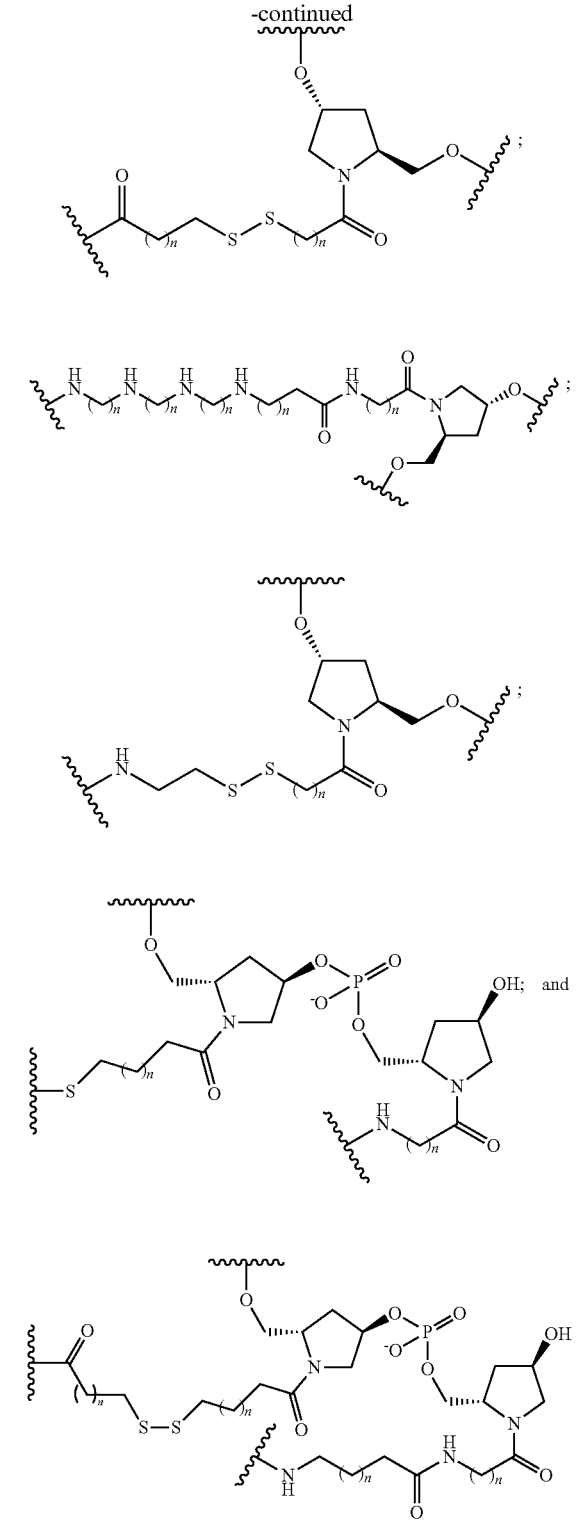
wherein each n is, independently from 1 to 20; and p is from 1 to 6.
Embodiment 296
The conjugated antisense compound of any of embodiments 229 to 295 wherein the conjugate linker has a structure selected from among:

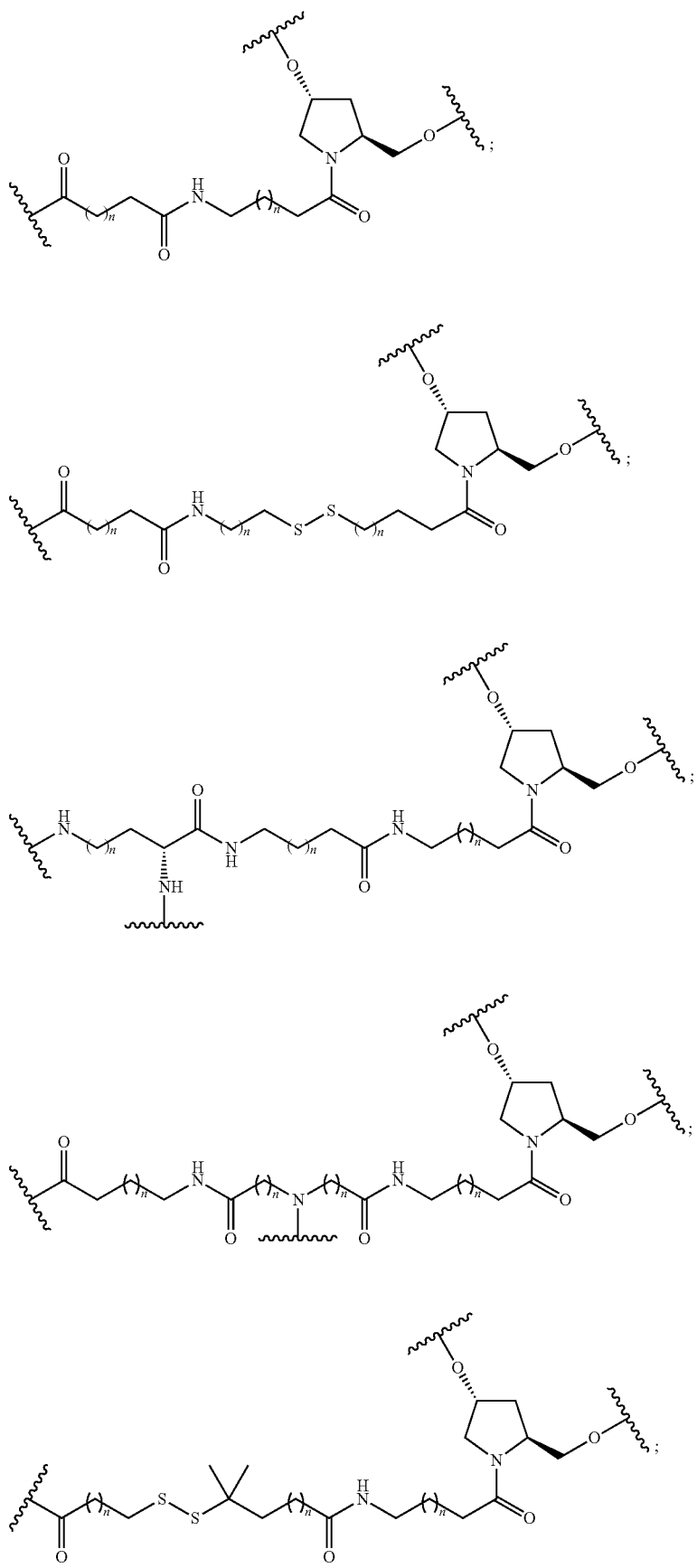

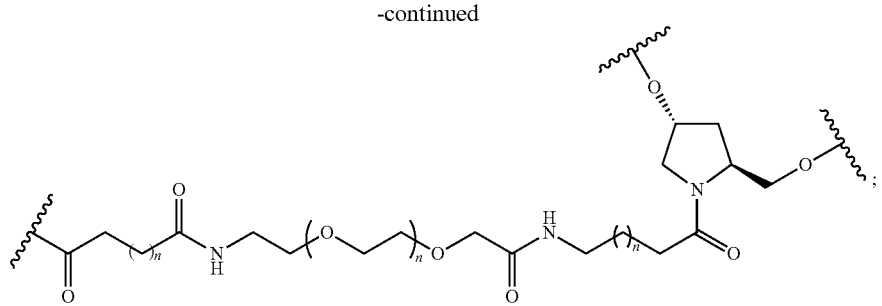
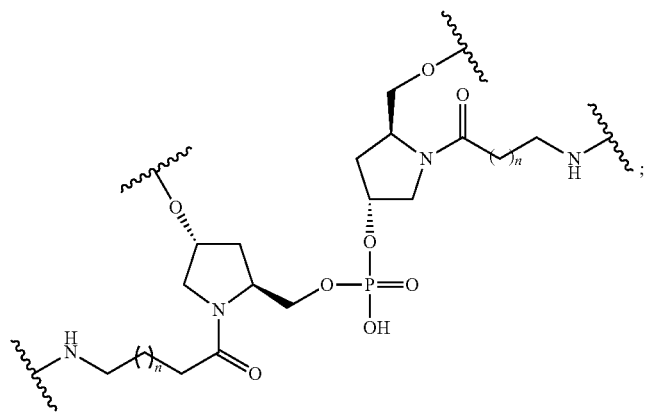
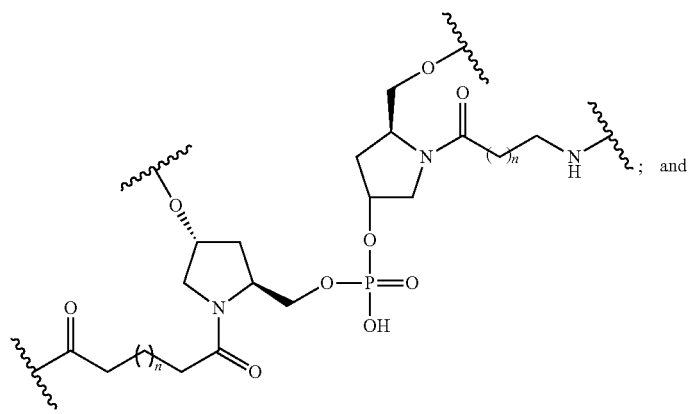
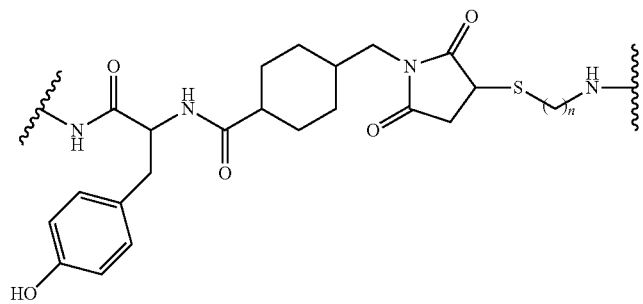
wherein each n is, independently, from 1 to 20.
Embodiment 297
The conjugated antisense compound of any of embodiments 229 to 295 wherein the conjugate linker has a structure selected from among:
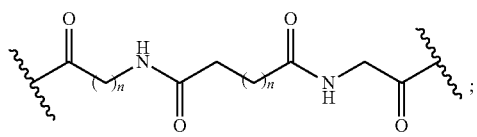

-continued
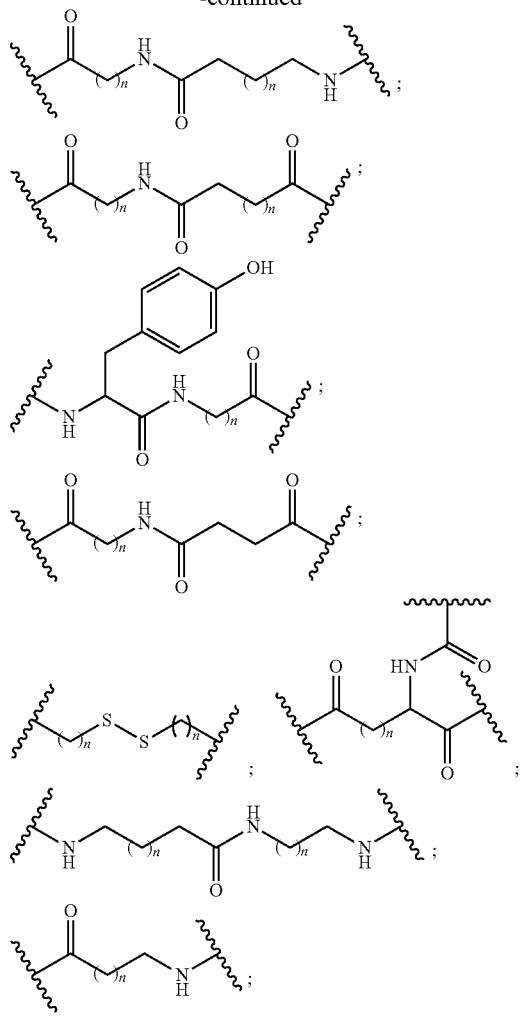
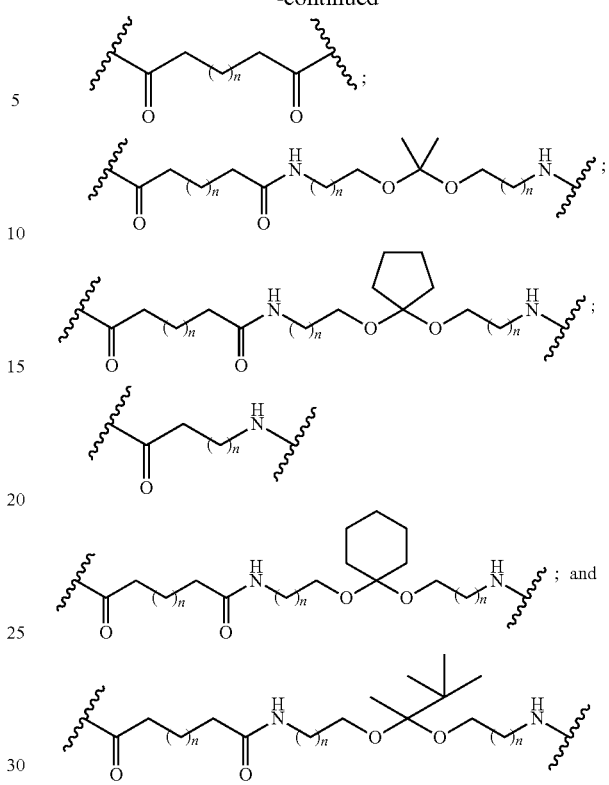
wherein each n is, independently, from 1 to 20.
Embodiment 298
The conjugated antisense compound of any of embodiments 229 to 295 wherein the conjugate linker has a structure selected from among:
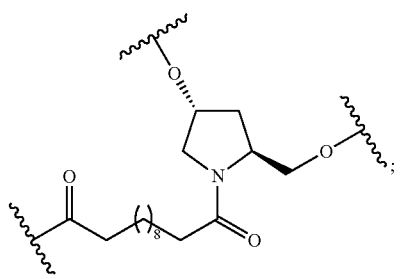
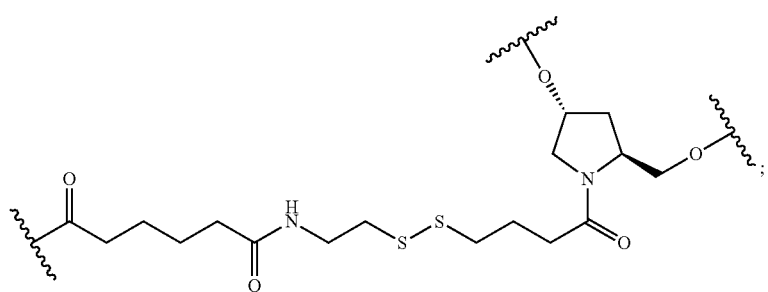

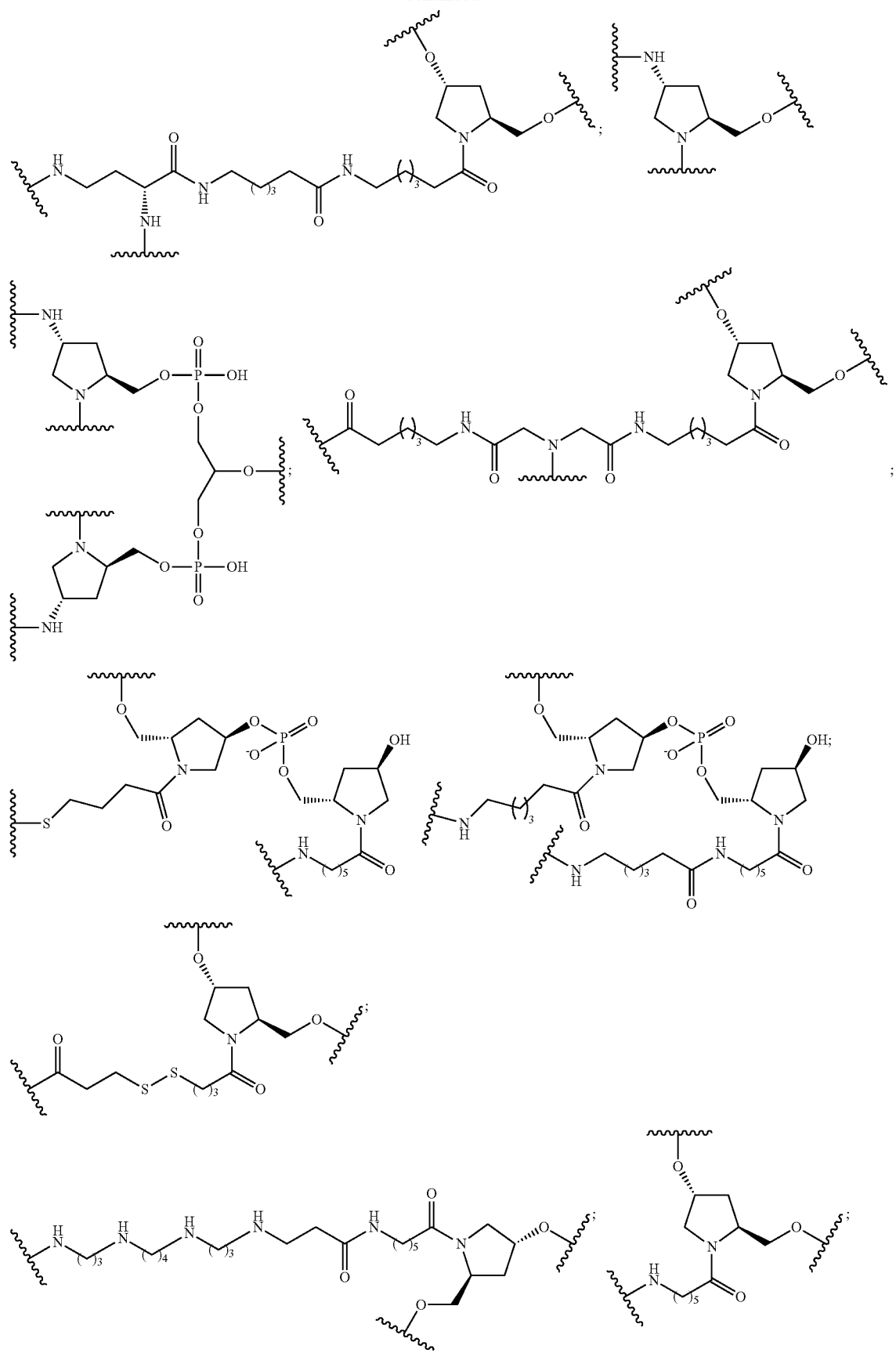

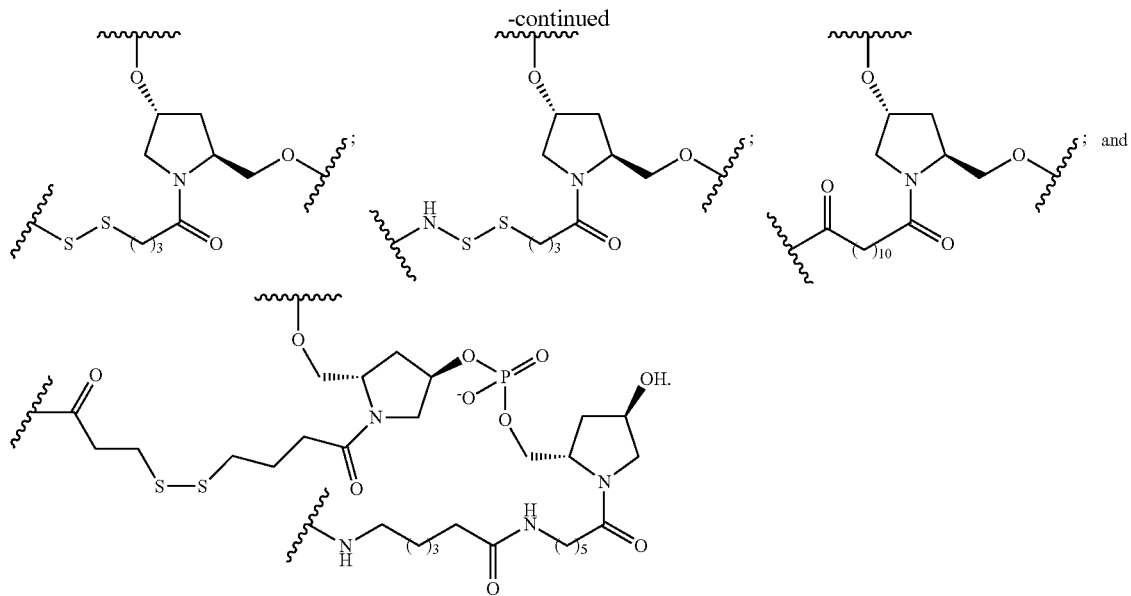
Embodiment 299
The conjugated antisense compound of any of embodiments 229 to 295 wherein the conjugate linker has a structure selected from among:
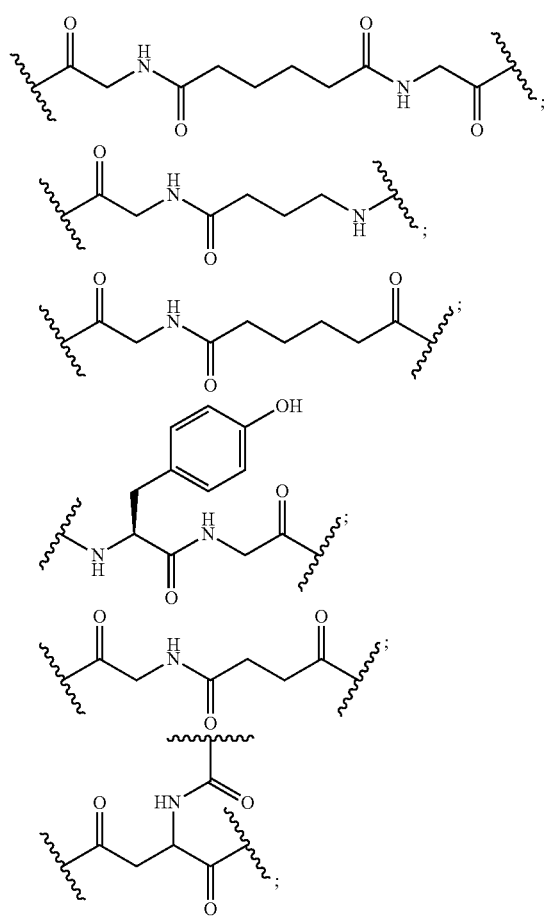

Embodiment 300

The conjugated antisense compound of any of embodiments 229 to 295 wherein the conjugate linker has a structure selected from among:

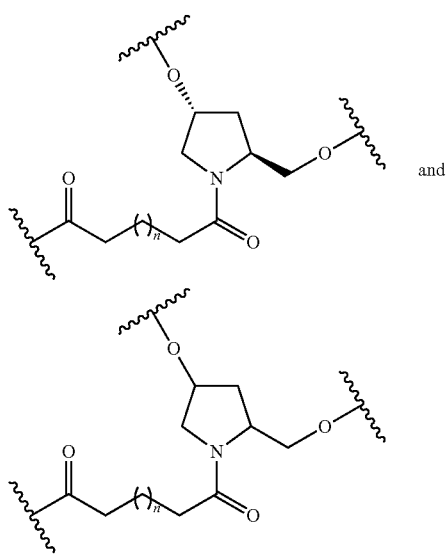 and wherein n is from 1 to 20.

Embodiment 301

The conjugated antisense compound of any of embodiments 229 to 295 wherein the conjugate linker has the structure:

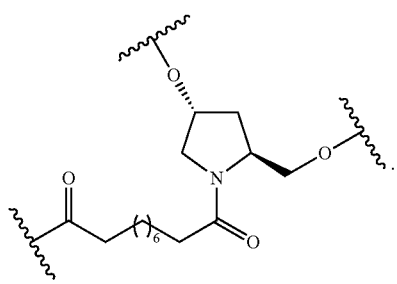

Embodiment 302

The conjugated antisense compound of any of embodiments 229 to 301, wherein the cell-targeting moiety comprises a carbohydrate.

Embodiment 303

The conjugated antisense compound of any of embodiments 229 to 302, wherein the cell-targeting moiety comprises a carbohydrate cluster.

Embodiment 304

The conjugated antisense compound of any of embodiments 229 to 303, wherein the cell-targeting moiety comprises a cell surface receptor ligand.

Embodiment 305

The conjugated antisense compound of any of embodiments 229 to 304, wherein the targeting moiety comprises at least one N-Acetylgalactosamine (GalNAc).

Embodiment 306

The conjugated antisense compound of any of embodiments 229 to 305, wherein the targeting moiety comprises a branching group.

Embodiment 307

The conjugated antisense compound of embodiment 306, wherein the branching group comprises an ether.

Embodiment 308

The conjugated antisense compound of embodiment 306 or 307, wherein the branching group has the following structure:

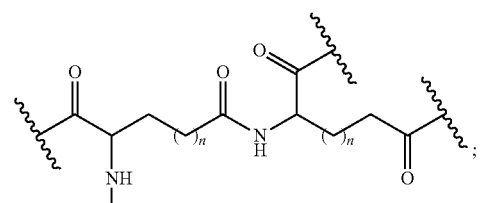

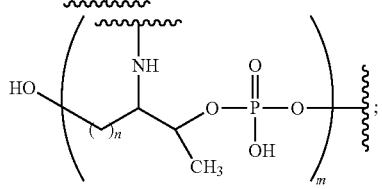

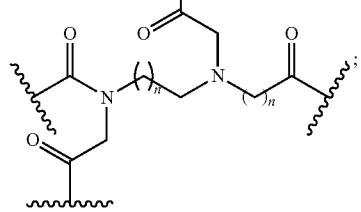

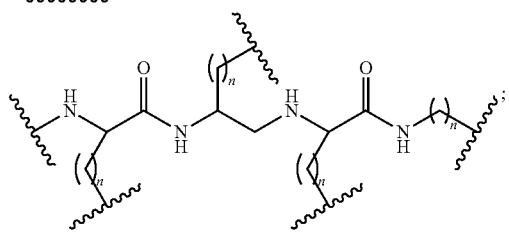

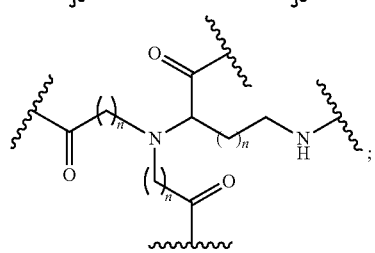

89
-continued
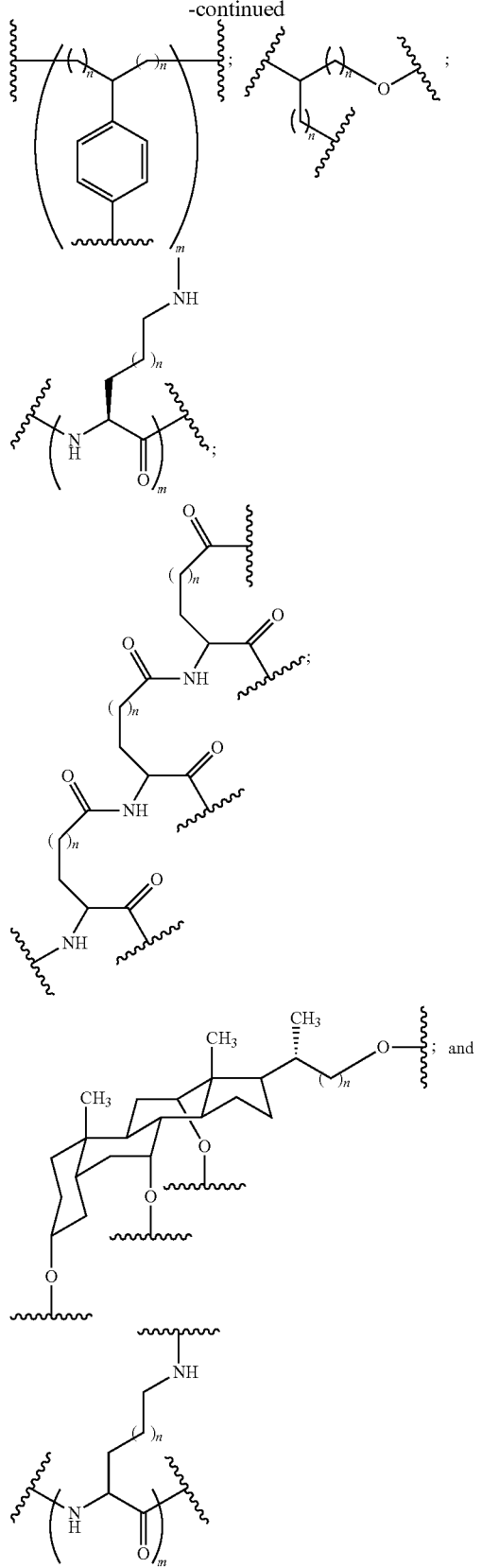
wherein each n is, independently, from 1 to 20; and m is from 2 to 6.
90
Embodiment 309
The conjugated antisense compound of embodiment 306 or 307, wherein the branching group has the following structure:
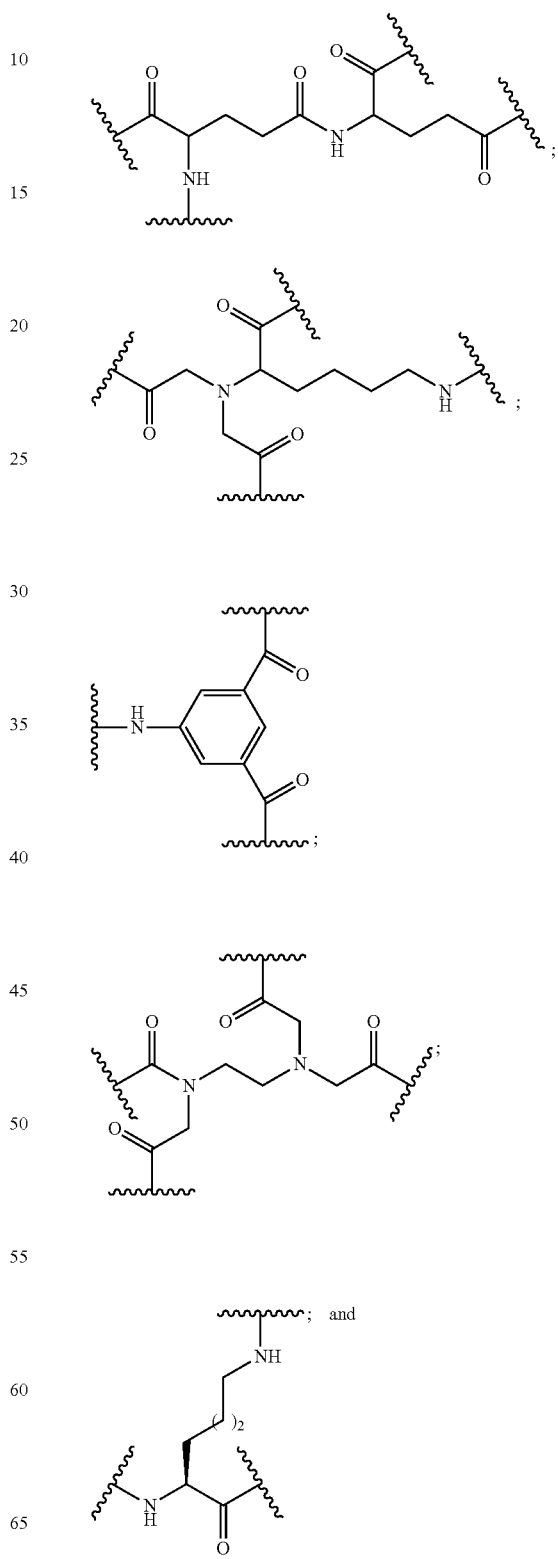

-continued

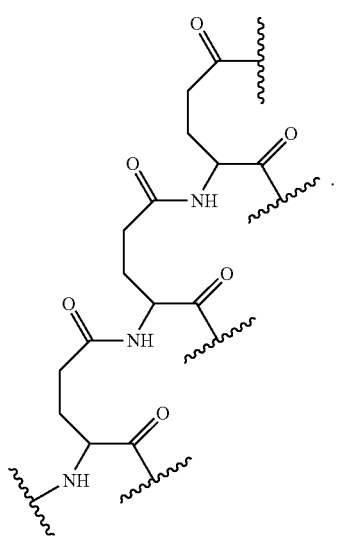 [SMILES: *NC(CCC(=O)NC(CCC(=O)NC(CCC(*)=O)C(*)=O)C(*)=O)C(*)=O]

Embodiment 310

The conjugated antisense compound of embodiment 306 or 307, wherein the branching group has the following structure:

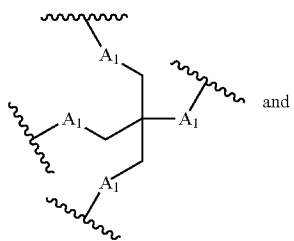
and
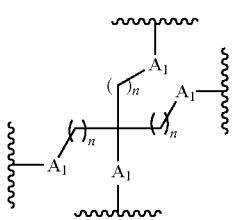

wherein each $A_1$ is independently, O, S, C=O or NH; and each n is, independently, from 1 to 20.

Embodiment 311

The conjugated antisense compound of embodiment 306 or 307, wherein the branching group has the following structure:

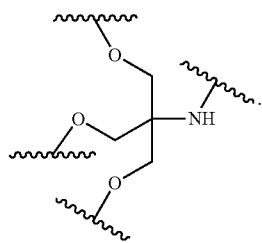 [SMILES: *NC(CO*)(CO*)CO*]

Embodiment 312

The conjugated antisense compound of any of embodiments 306 or 307 wherein the branching group comprises:

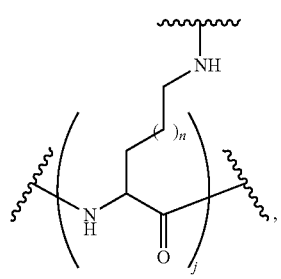

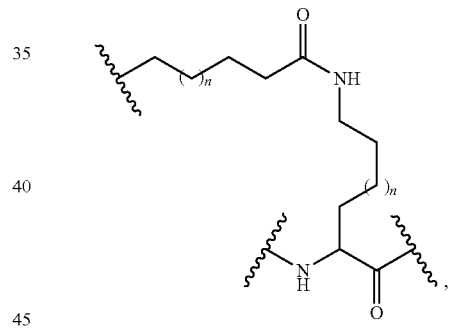

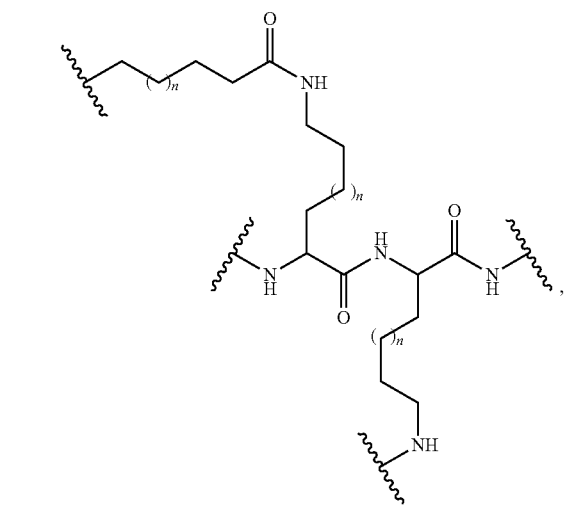

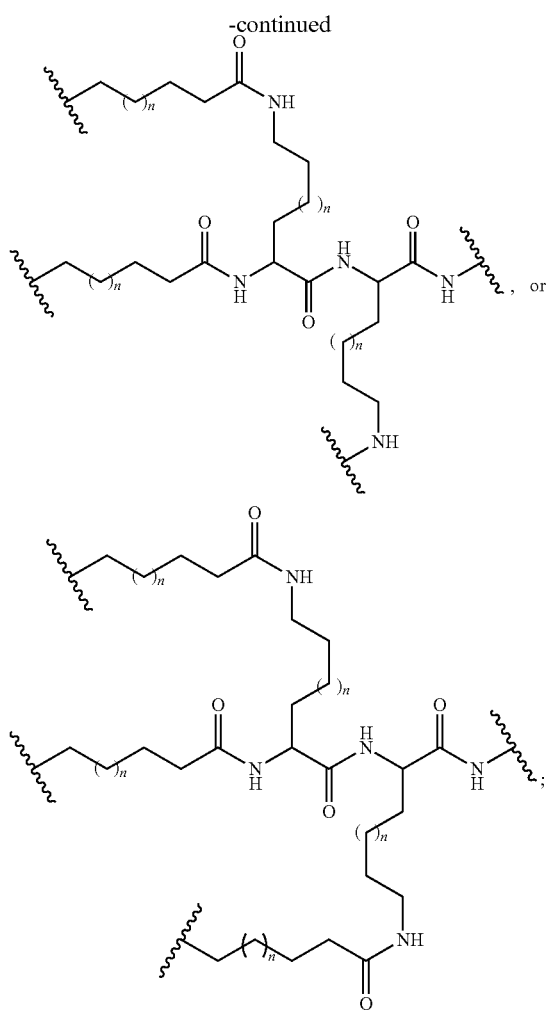
wherein each j is an integer from 1 to 3; and
wherein each n is an integer from 1 to 20.
Embodiment 313
The conjugated antisense compound of any of embodiments 306 or 307 wherein the branching group comprises:
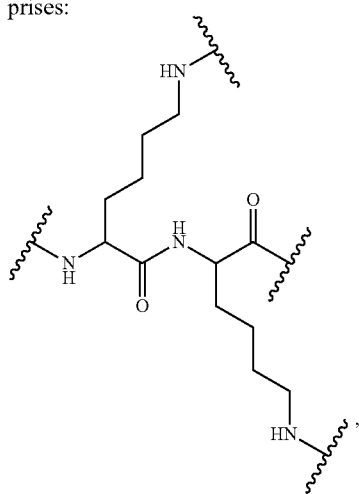
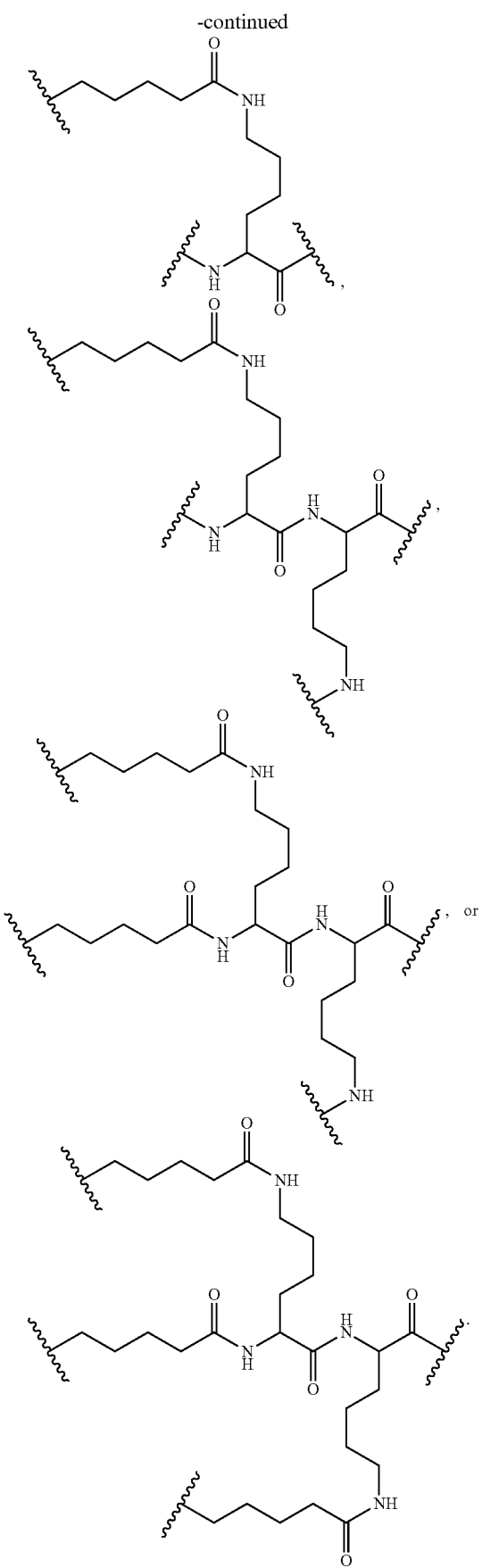

Embodiment 314

The conjugated antisense compound of any embodiments 229-313, wherein the cell-targeting moiety comprises a tether.

Embodiment 315

The conjugated antisense compound of any embodiments 229-313, wherein the cell-targeting moiety comprises two tethers.

Embodiment 316

The conjugated antisense compound of any embodiments 229-313, wherein the cell-targeting moiety comprises three tethers.

Embodiment 317

The conjugated antisense compound of any embodiments 229-313, wherein the cell-targeting moiety comprises four or more tethers.

Embodiment 318

The conjugated antisense compound of any of embodiments 229-317, wherein at least one tether comprises PEG.

Embodiment 319

The conjugated antisense compound of any of embodiments 229-318, wherein at least one tether comprises an amide.

Embodiment 320

The conjugated antisense compound of any of embodiments 229-319, wherein at least one tether comprises a polyamide.

Embodiment 321

The conjugated antisense compound of any of embodiments 229-320, wherein at least one tether comprises an amine

Embodiment 322

The conjugated antisense compound of any of embodiments 229-321, wherein at least two tethers are different from one another.

Embodiment 323

The conjugated antisense compound of any of embodiments 229-321, wherein all of the tethers are the same as one another.

Embodiment 324

The conjugated antisense compound of any of embodiments 229-323, wherein each tether is selected from among:

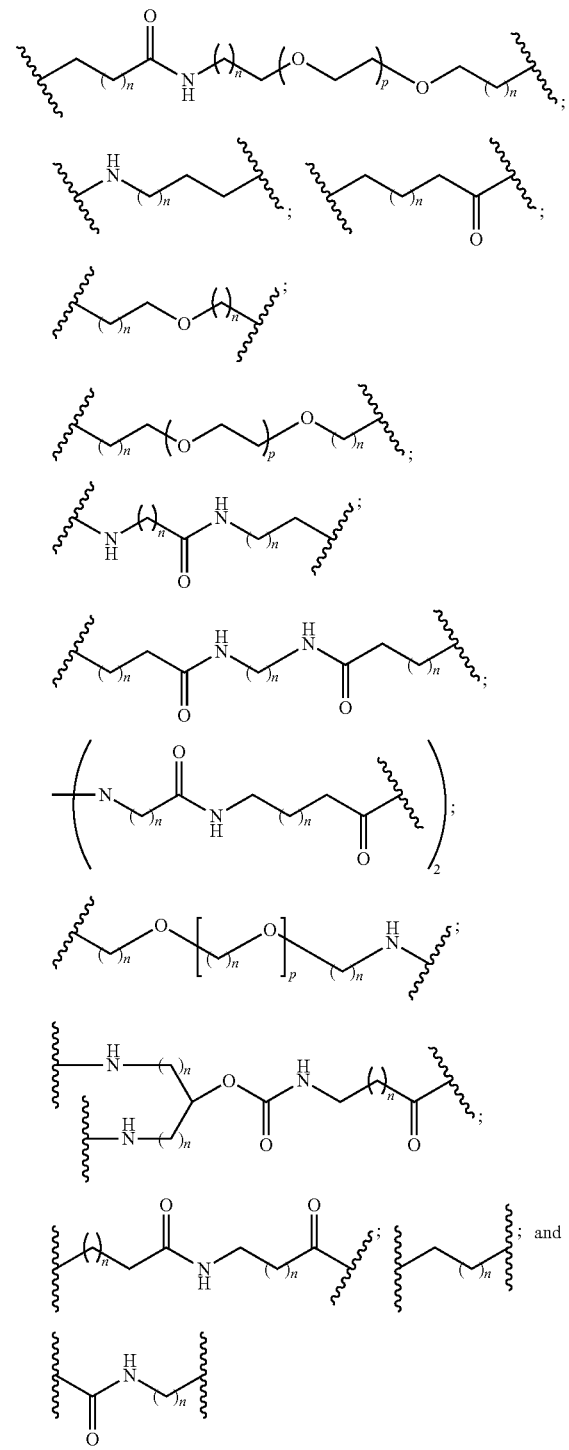

wherein each n is, independently, from 1 to 20; and each p is from 1 to about 6.

Embodiment 325

The conjugated antisense compound of any of embodiments 229-324, wherein each tether is selected from among:

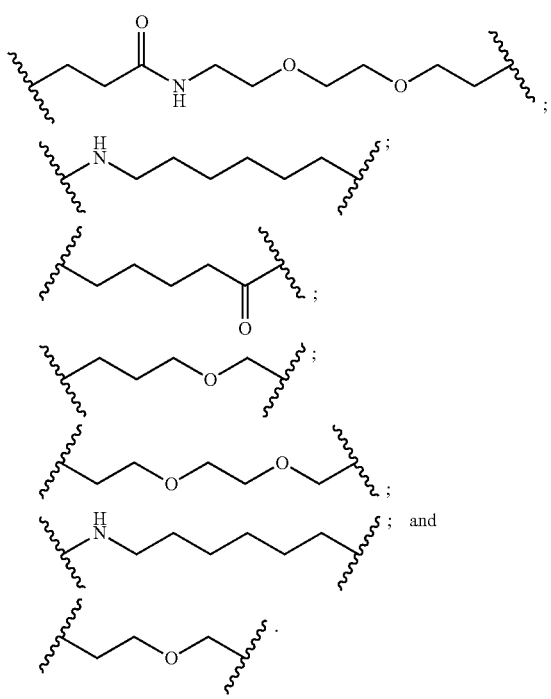

Embodiment 326

The conjugated antisense compound of any of embodiments 229-324, wherein each tether has the following structure:

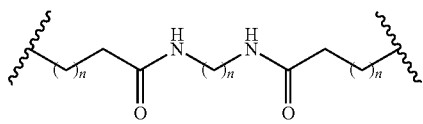

wherein each n is, independently, from 1 to 20.

Embodiment 327

The conjugated antisense compound of any of embodiments 229-324, wherein each tether has the following structure:

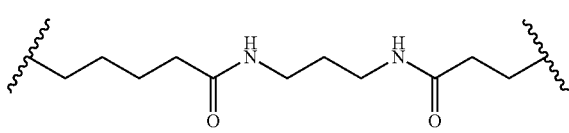 [SMILES: *CCCCC(=O)NCCCNC(=O)CC*]

Embodiment 328

The conjugated antisense compound of any of embodiments 229-328, wherein the cell-targeting moiety comprises at least one ligand.

Embodiment 329

The conjugated antisense compound of embodiment 328, wherein the cell-targeting moiety comprises one ligand.

Embodiment 330

The conjugated antisense compound of embodiment 328, wherein the targeting moiety comprises two ligands.

Embodiment 331

The conjugated antisense compound of embodiment 328, wherein the targeting moiety comprises three ligands.

Embodiment 332

The conjugated antisense compound of any of embodiments 328-331, wherein a ligand is covalently attached to each tether.

Embodiment 333

The conjugated antisense compound of any of embodiments 229-332, wherein at least one ligand is N-Acetylgalactosamine (GalNAc).

Embodiment 334

The conjugated antisense compound of any of embodiments 229-332, wherein each ligand is N-Acetylgalactosamine (GalNAc).

Embodiment 335

The conjugated antisense compound of any of embodiments 229-332, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, β-D-Mannofuranose, α-D-Mannopyranose, β-D-Mannopyranose, α-D-Glucopyranose, 3-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 336

The conjugated antisense compound of any of embodiments 229-332, wherein the ligand is galactose.

Embodiment 337

The conjugated antisense compound of any of embodiments 229-332, wherein the ligand is mannose-6-phosphate.

Embodiment 338

The conjugated antisense compound of any of embodiments 229-332, wherein each ligand is selected from among:

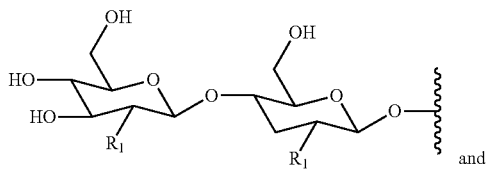 and

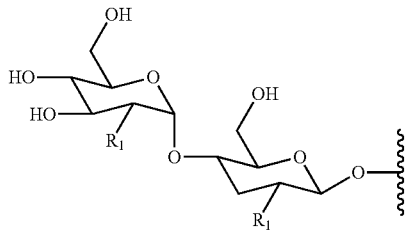

wherein each $R_1$ is selected from OH and NHCOOH.

Embodiment 339

The conjugated antisense compound of any of embodiments 229-332, wherein each ligand is selected from among:

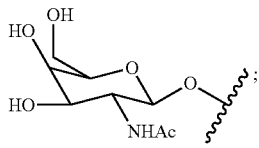

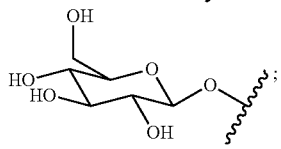

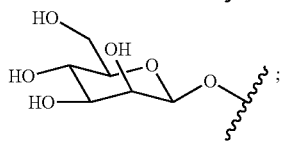

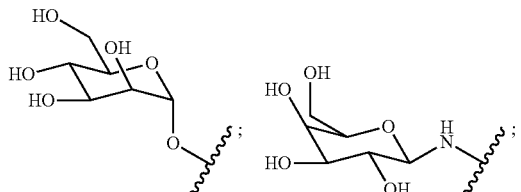

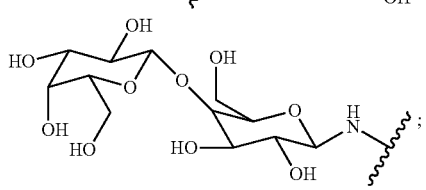

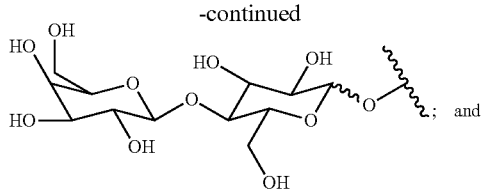 and

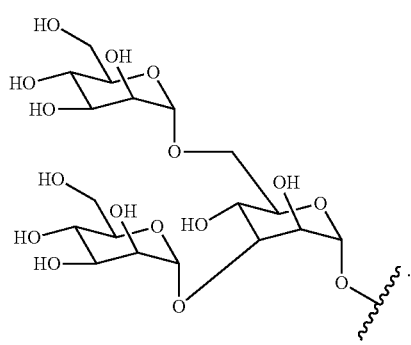

Embodiment 340

The conjugated antisense compound of any of embodiments 229-332, wherein each ligand has the following structure:

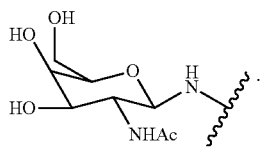 [SMILES: *NC1OC(CO)C(O)C(O)C1NC(C)=O]

Embodiment 341

The conjugated antisense compound of any of embodiments 229-332, wherein each ligand has the following structure:

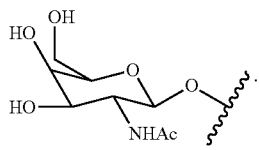 [SMILES: *OC1OC(CO)C(O)C(O)C1NC(C)=O]

Embodiment 342

The conjugated antisense compound of any of embodiments 229-332, wherein the cell-targeting group has the following structure:

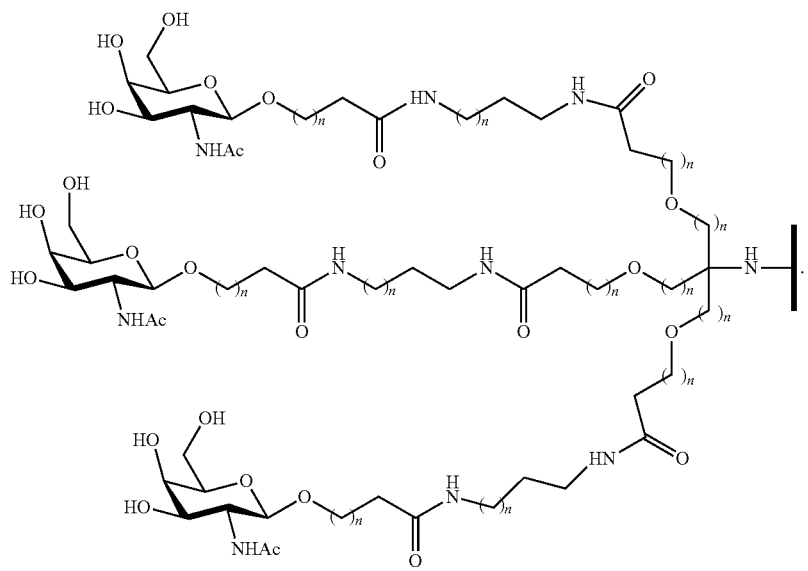
wherein each n is, independently, from 1 to 20.
Embodiment 343
The conjugated antisense compound of any of embodiments 229-336, wherein the cell-targeting group has the following structure:
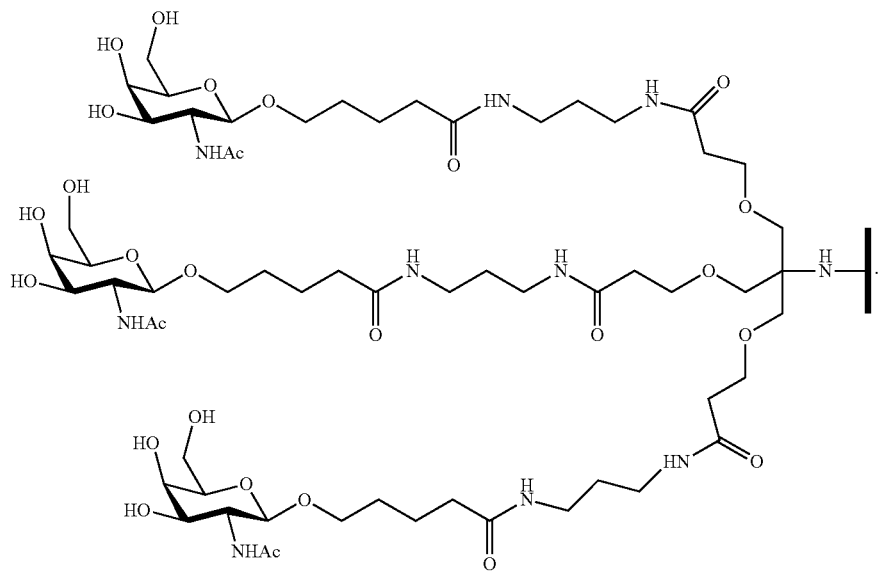
Embodiment 344
The conjugated antisense compound of any of embodiments 229-336, wherein the conjugate has the following structure:

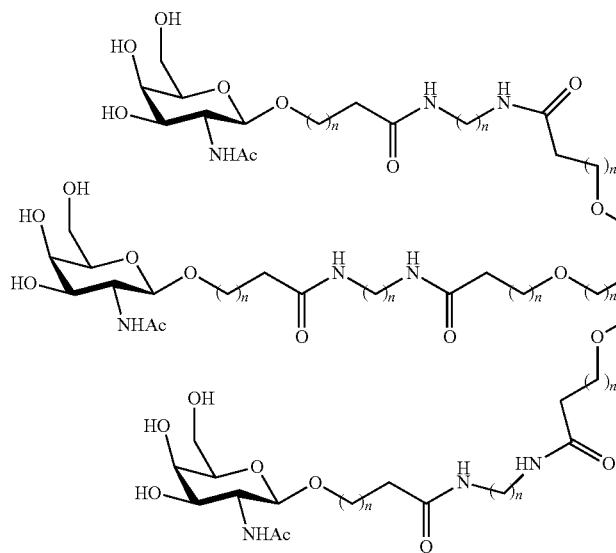

wherein each n is, independently, from 1 to 20;
Z is H or a linked solid support;
Q is said antisense compound;
X is O or S; and
Bx is a heterocyclic base moiety.

Embodiment 345

The conjugated antisense compound of any of embodiments 229-336, wherein the conjugate has the following structure:

wherein Z is H or a linked solid support; and
Q is said antisense compound.

Embodiment 346

The conjugated antisense compound of any of embodiments 229-345, wherein the conjugate group is attached to the 2'-position of a nucleoside of the antisense oligonucleotide.

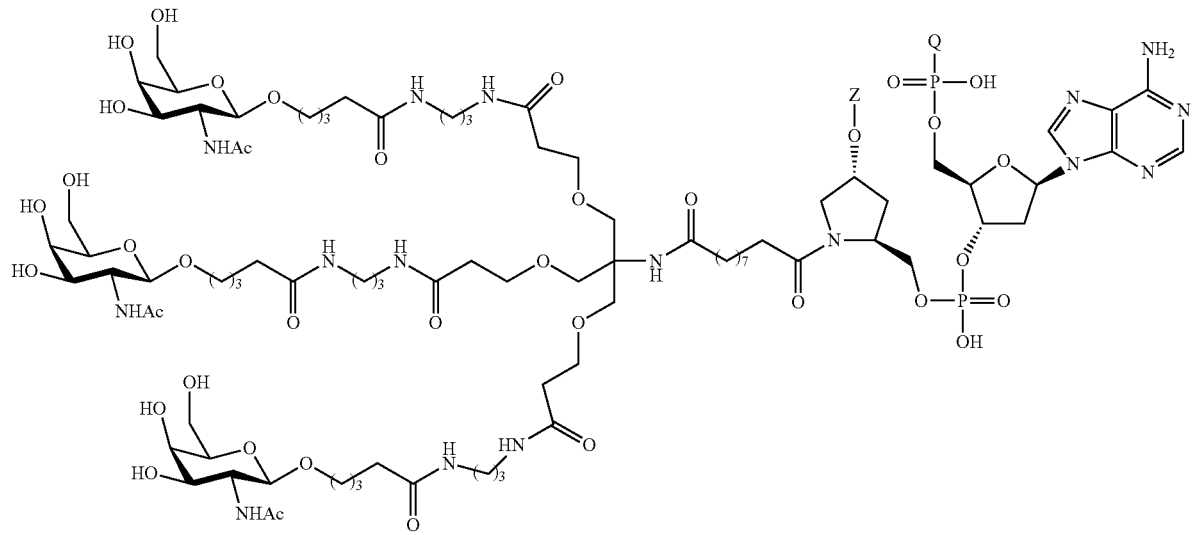

Embodiment 347

The conjugated antisense compound of any of embodiments 229-345, wherein the conjugate group is attached to the 3'-position of a nucleoside of the antisense oligonucleotide.

Embodiment 348

The conjugated antisense compound of any of embodiments 229-345, wherein the conjugate group is attached to the 5'-position of a nucleoside of the antisense oligonucleotide.

Embodiment 349

The conjugated antisense compound of any of embodiments 229-345, wherein the conjugate group is attached to the 5'-terminal nucleoside of the antisense oligonucleotide.

Embodiment 350

The conjugated antisense compound of any of embodiments 229-350, wherein the conjugate group is attached to the 3'-terminal nucleoside of the antisense oligonucleotide.

Embodiment 351

The conjugated antisense compound of any of embodiments 229-350, wherein the conjugate group is attached to an internal nucleoside of the antisense oligonucleotide.

Embodiment 352

The conjugated antisense compound of any of embodiments 229-351, wherein the conjugate group increases uptake of the conjugated antisense compound into a hepatocyte relative to an unconjugated antisense compound.

Embodiment 353

The conjugated antisense compound of any of embodiments 229-352, wherein the conjugate group increases the uptake of the conjugated antisense compound into a liver cell relative to an unconjugated antisense compound.

Embodiment 354

The conjugated antisense compound of any of embodiments 229-353, wherein the conjugate group increases accumulation of the conjugated antisense compound in the liver relative to an unconjugated antisense compound.

Embodiment 355

The conjugated antisense compound of any of embodiments 229-354, wherein the conjugate group decreases accumulation of the conjugated antisense compound in the kidneys relative to an unconjugated antisense compound.

Embodiment 356

The conjugated antisense compound of any of embodiments 229-355, wherein the antisense oligonucleotide is an RNase H based antisense compound.

Embodiment 357

The conjugated antisense compound of any of embodiments 229-356, wherein the antisense oligonucleotide comprises at least one modified nucleoside.

Embodiment 358

The conjugated antisense compound of any of embodiments 229-357, wherein each nucleoside of the antisense oligonucleotide is a modified nucleoside.

Embodiment 359

The conjugated antisense compound of any of embodiments 229-358, wherein the antisense oligonucleotide is single-stranded.

Embodiment 360

The conjugated antisense compound of embodiment 357-359, wherein at least one modified nucleoside comprises a modified sugar moiety.

Embodiment 361

The conjugated antisense compound of embodiment 359, wherein the antisense oligonucleotide has a sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 362

The conjugated antisense compound of embodiment 361, wherein the 5'-region consists of 2 linked 5'-region nucleosides.

Embodiment 363

The conjugated antisense compound of embodiment 361, wherein the 5'-region consists of 3 linked 5'-region nucleosides.

Embodiment 364

The conjugated antisense compound of embodiment 361, wherein the 5'-region consists of 4 linked 5'-region nucleosides.

Embodiment 365

The conjugated antisense compound of embodiment 361, wherein the 5'-region consists of 5 linked 5'-region nucleosides.

Embodiment 366

The conjugated antisense compound of any of embodiments 361-365, wherein the 3'-region consists of 2 linked 3'-region nucleosides.

Embodiment 367

The conjugated antisense compound of any of embodiments 361-365, wherein the 3'-region consists of 3 linked 3'-region nucleosides.

Embodiment 368

The conjugated antisense compound of any of embodiments 361-365, wherein the 3'-region consists of 4 linked 3'-region nucleosides.

Embodiment 369

The conjugated antisense compound of any of embodiments 361-365, wherein the 3'-region consists of 5 linked 3'-region nucleosides.

Embodiment 370

The conjugated antisense compound of any of embodiments 361-369, wherein the central region consists of 5 linked central region nucleosides.

Embodiment 371

The conjugated antisense compound of any of embodiments 361-369, wherein the central region consists of 6 linked central region nucleosides.

Embodiment 372

The conjugated antisense compound of any of embodiments 361-369, wherein the central region consists of 7 linked central region nucleosides.

Embodiment 373

The conjugated antisense compound of any of embodiments 361-369, wherein the central region consists of 8 linked central region nucleosides.

Embodiment 374

The conjugated antisense compound of any of embodiments 361-369, wherein the central region consists of 9 linked central region nucleosides.

Embodiment 375

The conjugated antisense compound of any of embodiments 361-369, wherein the central region consists of 10 linked central region nucleosides.

Embodiment 376

The conjugated antisense compound of any of embodiments 229-376, wherein the antisense oligonucleotide consists of 14 to 26 linked nucleosides.

Embodiment 377

The conjugated antisense compound of any of embodiments 229-376, wherein the antisense oligonucleotide consists of 15 to 25 linked nucleosides.

Embodiment 378

The conjugated antisense compound of any of embodiments 229-376, wherein the antisense oligonucleotide consists of 16 to 20 linked nucleosides.

Embodiment 379

The conjugated antisense compound of any of embodiments 229-378, wherein each modified nucleoside independently comprises a 2'-substituted sugar moiety or a bicyclic sugar moiety.

Embodiment 380

The conjugated antisense compound of embodiment 379, wherein the at least one modified nucleoside comprises a 2'-substituted sugar moiety.

Embodiment 381

The conjugated antisense compound of embodiment 380, wherein each modified nucleoside comprising a 2'-substituted sugar moiety comprises a 2' substituent independently selected from among: halogen, optionally substituted allyl, optionally substituted amino, azido, optionally substituted SH, CN, OCN, CF3, OCF3, O, S, or N(Rm)-alkyl; O, S, or N(Rm)-alkenyl; O, S or N(Rm)-alkynyl; optionally substituted O-alkylenyl-O-alkyl, optionally substituted alkynyl, optionally substituted alkaryl, optionally substituted aralkyl, optionally substituted O-alkaryl, optionally substituted O-aralkyl, $O(CH2)2SCH3$, $O—(CH2)_2—O—N(Rm)(Rn)$ or $O—CH2-C(=O)—N(Rm)(Rn)$, where each Rm and Rn is, independently, H, an amino protecting group or substituted or unsubstituted $C_1$-$C_{10}$ alkyl;

wherein each optionally substituted group is optionally substituted with a substituent group independently selected from among: hydroxyl, amino, alkoxy, carboxy, benzyl, phenyl, nitro ($NO_2$), thiol, thioalkoxy (S-alkyl), halogen, alkyl, aryl, alkenyl and alkynyl.

Embodiment 382

The conjugated antisense compound of embodiment 380, wherein each 2' substituent is independently selected from among: a halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2—CH=CH_2$, $O(CH_2)_2—OCH_3$, $O(CH_2)_2—$ $SCH_3$, $O(CH_2)_2$—$OCF_3$, $O(CH_2)_3$—$N(R_1)(R_2)$, $O(CH_2)_2$—$ON(R_1)(R_2)$, $O(CH_2)_2$—$O(CH_2)_2$—$N(R_1)$ $(R_2)$, $OCH_2C(=O)$—$N(R_1)(R_2)$, $OCH_2C(=O)$—$N(R_3)$—$(CH_2)_2$—$N(R_1)(R_2)$, and $O(CH_2)_2$—$N(R_3)$—$C(=NR_4)[N(R_1)(R_2)]$; wherein $R_1$, $R_2$, $R_3$ and $R_4$ are each, independently, H or $C_1$-$C_6$ alkyl.

Embodiment 383

The conjugated antisense compound of embodiment 380, wherein each 2' substituent is independently selected from among: a halogen, $OCH_3$, $OCF_3$, $OCH_2CH_3$, $OCH_2CF_3$, $OCH_2$—$CH=CH_2$, $O(CH_2)_2$—$OCH_3$ (MOE), $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$.

Embodiment 384

The conjugated antisense compound of embodiment 380, wherein the at least one 2'-modified nucleoside comprises a 2'-MOE sugar moiety.

Embodiment 385

The conjugated antisense compound of embodiment 380, wherein the at least one 2'-modified nucleoside comprises a 2'-OMe sugar moiety.

Embodiment 386

The conjugated antisense compound of embodiment 380, wherein the at least one 2'-modified nucleoside comprises a 2'-F sugar moiety.

Embodiment 387

The conjugated antisense compound of any of embodiments 229-386, wherein the antisense oligonucleotide comprises at least one modified nucleoside comprising a sugar surrogate.

Embodiment 388

The conjugated antisense compound of embodiment 387, wherein the modified nucleoside comprises an F-HNA sugar moiety.

Embodiment 389

The conjugated antisense compound of embodiment 387, wherein the modified nucleoside comprises an HNA sugar moiety.

Embodiment 390

The conjugated antisense compound of any of embodiments 229-389 wherein the antisense oligonucleotide comprises at least one modified nucleoside comprising a bicyclic sugar moiety.

Embodiment 391

The conjugated antisense compound of embodiment 390, wherein the bicyclic sugar moiety is a cEt sugar moiety.

Embodiment 392

The conjugated antisense compound of embodiment 390, wherein bicyclic sugar moiety is an LNA sugar moiety.

Embodiment 393

The conjugated antisense compound of any of embodiments 1-392, wherein the antisense oligonucleotide comprises at least one modified internucleoside linkage.

Embodiment 394

The conjugated antisense compound of embodiment 393, wherein each internucleoside linkage of the antisense oligonucleotide is a modified internucleoside linkage.

Embodiment 395

The conjugated antisense compound of embodiment 394, wherein the antisense oligonucleotide comprises at least one modified linkage and at least one unmodified phosphodiester internucleoside linkage.

Embodiment 396

The conjugated antisense compound of any of embodiments 393-395 wherein at least one modified internucleoside linkage is a phosphosphorothioate internucleoside linkage.

Embodiment 397

The conjugated antisense compound of any of embodiments 393-396, wherein each modified internucleoside linkage is a phosphorothioate internucleoside linkage.

Embodiment 398

The conjugated antisense compound of any of embodiments 393-396, wherein the antisense oligonucleotide comprises at least 2 phosphodiester internucleoside linkages.

Embodiment 399

The conjugated antisense compound of any of embodiments 393-396, wherein the antisense oligonucleotide comprises at least 3 phosphodiester internucleoside linkages.

Embodiment 400

The conjugated antisense compound of any of embodiments 393-396, wherein the antisense oligonucleotide comprises at least 4 phosphodiester internucleoside linkages.

Embodiment 401

The conjugated antisense compound of any of embodiments 393-396, wherein the antisense oligonucleotide comprises at least 5 phosphodiester internucleoside linkages.

Embodiment 402

The conjugated antisense compound of any of embodiments 393-396, wherein the antisense oligonucleotide comprises at least 6 phosphodiester internucleoside linkages.

Embodiment 403

The conjugated antisense compound of any of embodiments 393-396, wherein the antisense oligonucleotide comprises at least 7 phosphodiester internucleoside linkages.

Embodiment 404

The conjugated antisense compound of any of embodiments 393-396, wherein the antisense oligonucleotide comprises at least 8 phosphodiester internucleoside linkages.

Embodiment 405

The conjugated antisense compound of any of embodiments 393-396, wherein the antisense oligonucleotide comprises at least 9 phosphodiester internucleoside linkages.

Embodiment 406

The conjugated antisense compound of any of embodiments 393-396, wherein the antisense oligonucleotide comprises at least 10 phosphodiester internucleoside linkages.

Embodiment 407

The conjugated antisense compound of any of embodiments 393-396 or 398-406, wherein the antisense oligonucleotide comprises fewer than 16 phosphorothioate internucleoside linkages.

Embodiment 408

The conjugated antisense compound of any of embodiments 393-396 or 398-406, wherein the antisense oligonucleotide comprises fewer than 15 phosphorothioate internucleoside linkages.

Embodiment 409

The conjugated antisense compound of any of embodiments 393-396 or 398-406, wherein the antisense oligonucleotide comprises fewer than 14 phosphorothioate internucleoside linkages.

Embodiment 410

The conjugated antisense compound of any of embodiments 393-396 or 398-406, wherein the antisense oligonucleotide comprises fewer than 13 phosphorothioate internucleoside linkages.

Embodiment 411

The conjugated antisense compound of any of embodiments 393-396 or 398-406, wherein the antisense oligonucleotide comprises fewer than 12 phosphorothioate internucleoside linkages.

Embodiment 412

The conjugated antisense compound of any of embodiments 393-396 or 398-406, wherein the antisense oligonucleotide comprises fewer than 11 phosphorothioate internucleoside linkages.

Embodiment 413

The conjugated antisense compound of any of embodiments 393-396 or 398-406, wherein the antisense oligonucleotide comprises fewer than 10 phosphorothioate internucleoside linkages.

Embodiment 414

The conjugated antisense compound of any of embodiments 393-396 or 398-406, wherein the antisense oligonucleotide comprises fewer than 9 phosphorothioate internucleoside linkages.

Embodiment 415

The conjugated antisense compound of any of embodiments 393-396 or 398-406, wherein the antisense oligonucleotide comprises fewer than 8 phosphorothioate internucleoside linkages.

Embodiment 416

The conjugated antisense compound of any of embodiments 393-396 or 398-406, wherein the antisense oligonucleotide comprises fewer than 7 phosphorothioate internucleoside linkages.

Embodiment 417

The conjugated antisense compound of any of embodiments 393-396 or 398-406, wherein the antisense oligonucleotide comprises fewer than 6 phosphorothioate internucleoside linkages.

Embodiment 418

The conjugated antisense compound of any of embodiments 393-418, wherein each terminal internucleoside linkage of the antisense oligonucleotide is a phosphorothioate internucleoside linkage.

Embodiment 419

The conjugated antisense compound of any of embodiments 393-396 or 398-418, wherein each internucleoside linkage linking two deoxynucleosides of the antisense oligonucleotide is a phosphorothioate internucleoside linkage.

Embodiment 420

The conjugated antisense compound of any of embodiments 393-396 or 398-419, wherein each non-terminal internucleoside linkage linking two modified nucleosides of the antisense oligonucleotide is a phosphodiester internucleoside linkage.

Embodiment 421

The conjugated antisense compound of any of embodiments 393-396 or 398-420, wherein each non-terminal internucleoside linkage of the antisense oligonucleotide that is 3' of a modified nucleoside is a phosphodiester internucleoside linkage.

Embodiment 422

The conjugated antisense compound of any of embodiments 393-396 or 398-418, wherein each internucleoside linkage of the antisense oligonucleotide that is 3' of a deoxynucleoside is a phosphorothioate internucleoside linkage.

Embodiment 423

The conjugated antisense compound of any of embodiments 229-422 wherein the antisense oligonucleotides has a chemical motif selected from among:
MsMy(Ds)$_{0-1}$(DsDs)$_{(3-5)}$MsM
MsMy(Ds)$_{0-1}$(DsDs)$_{(3-5)}$MyMsM
MsMy(Ds)$_{0-1}$(DsDs)$_{(3-5)}$MyMyMsM
MsMy(Ds)$_{0-1}$(DsDs)$_{(3-5)}$MyMyMyMsM
MsMyMy(Ds)$_{0-1}$(DsDs)$_{(3-5)}$MsM
MsMyMy(Ds)$_{0-1}$(DsDs)$_{(3-5)}$MyMsM
MsMyMy(Ds)$_{0-1}$(DsDs)$_{(3-5)}$MyMyMsM
MsMyMy(Ds)$_{0-1}$(DsDs)$_{(3-5)}$MyMyMyMsM
MsMyMyMy(Ds)$_{0-1}$(DsDs)$_{(3-5)}$MsM
MsMyMyMy(Ds)$_{0-1}$(DsDs)$_{(3-5)}$MyMsM
MsMyMyMy(Ds)$_{0-1}$(DsDs)$_{(3-5)}$MyMyMsM
MsMyMyMy(Ds)$_{0-1}$(DsDs)$_{(3-5)}$MyMyMyMsM
MsMyMyMyMy(Ds)$_{0-1}$(DsDs)$_{(3-5)}$MsM
MsMyMyMyMy(Ds)$_{0-1}$(DsDs)$_{(3-5)}$MyMsM
MsMyMyMyMy(Ds)$_{0-1}$(DsDs)$_{(3-5)}$MyMyMsM; and
MsMyMyMyMy(Ds)$_{0-1}$(DsDs)$_{(3-5)}$MyMyMyMsM;
wherein each M is independently a modified nucleoside, each D is a deoxynucleoside; each s is a phosphorothioate internucleoside linkage, and each y is either a phosphodiester internucleoside linkage or a phosphorothioate internucleoside linkage, provided that at least one y is a phosphodiester internucleotide linkage.

Embodiment 424

The conjugated antisense compound of any of embodiments 229-422 wherein the antisense oligonucleotides has a chemical motif selected from among:
MsMo(Ds)$_{0-1}$(DsDs)$_{(3-5)}$MoMsM
MsMo(Ds)$_{0-1}$(DsDs)$_{(3-5)}$MoMoMsM
MsMo(Ds)$_{0-1}$(DsDs)$_{(3-5)}$MoMoMoMsM
MsMoMo(Ds)$_{0-1}$(DsDs)$_{(3-5)}$MsM
MsMoMo(Ds)$_{0-1}$(DsDs)$_{(3-5)}$MoMsM
MsMoMo(Ds)$_{0-1}$(DsDs)$_{(3-5)}$MoMoMsM
MsMoMo(Ds)$_{0-1}$(DsDs)$_{(3-5)}$MoMoMoMsM
MsMoMoMo(Ds)$_{0-1}$(DsDs)$_{(3-5)}$MsM
MsMoMoMo(Ds)$_{0-1}$(DsDs)$_{(3-5)}$MoMsM
MsMoMoMo(Ds)$_{0-1}$(DsDs)$_{(3-5)}$MoMoMsM
MsMoMoMo(Ds)$_{0-1}$(DsDs)$_{(3-5)}$MoMoMoMsM
MsMoMoMoMo(Ds)$_{0-1}$(DsDs)$_{(3-5)}$MsM
MsMoMoMoMo(Ds)$_{0-1}$(DsDs)$_{(3-5)}$MoMsM
MsMoMoMoMo(Ds)$_{0-1}$(DsDs)$_{(3-5)}$MoMoMsM; and
MsMoMoMoMo(Ds)$_{0-1}$(DsDs)$_{(3-5)}$MoMoMoMsM;
wherein each M is independently a modified nucleoside, each D is a deoxynucleoside; each o is a phosphodiester internucleoside linkage, and each s is a phosphorothioate internucleoside linkage.

Embodiment 425

The conjugated antisense compound of embodiment 423 or 424, wherein each M is independently selected from among: a 2'-MOE nucleoside and a bicyclic nucleoside.

Embodiment 426

The conjugated antisense compound of embodiment 425, wherein each M is independently selected from among a 2'-MOE nucleoside, a cEt nucleoside, and an LNA nucleoside.

Embodiment 427

The conjugated antisense compound of embodiment 425 or 426, wherein each M is a 2'-MOE nucleoside.

Embodiment 428

The conjugated antisense compound of embodiment 425 or 426, wherein each M is a cEt nucleoside.

Embodiment 429

The conjugated antisense compound of embodiments 425 or 426, wherein each M is an LNA nucleoside.

Embodiment 430

The conjugated antisense compound of any of embodiments 229-429, wherein the antisense oligonucleotide has a nucleobase sequence comprising an at least 8 nucleobase portion complementary to an equal length portion of a target nucleic acid.

Embodiment 431

The conjugated antisense compound of any of embodiments 229-429, wherein the antisense oligonucleotide has a nucleobase sequence comprising an at least 10 nucleobase portion complementary to an equal length portion of a target nucleic acid.

Embodiment 432

The conjugated antisense compound of any of embodiments 229-429, wherein the antisense oligonucleotide has a nucleobase sequence comprising an at least 12 nucleobase portion complementary to an equal length portion of a target nucleic acid.

Embodiment 433

The conjugated antisense compound of any of embodiments 229-429, wherein the antisense oligonucleotide has a nucleobase sequence comprising an at least 14 nucleobase portion complementary to an equal length portion of a target nucleic acid.

Embodiment 434

The conjugated antisense compound of any of embodiments 229-429, wherein the antisense oligonucleotide has a nucleobase sequence comprising an at least 16 nucleobase portion complementary to an equal length portion of a target nucleic acid.

Embodiment 435

The conjugated antisense compound of any of embodiments 229-429, wherein the antisense oligonucleotide has a nucleobase sequence comprising an at least 18 nucleobase portion complementary to an equal length portion of a target nucleic acid.

Embodiment 436

The conjugated antisense compound of any of embodiments 229-435, wherein the antisense oligonucleotide is at least 90% complementary to a target nucleic acid.

Embodiment 437

The conjugated antisense compound of any of embodiments 229-435, wherein the antisense oligonucleotide is at least 95% complementary to a target nucleic acid.

Embodiment 438

The conjugated antisense compound of any of embodiments 229-435, wherein the antisense oligonucleotide is 100% complementary to a target nucleic acid.

Embodiment 439

The conjugated antisense compound of any of embodiments 430-438, wherein the target nucleic acid is a pre-mRNA.

Embodiment 440

The conjugated antisense compound of any of embodiments 430-438, wherein the target nucleic acid is an mRNA.

Embodiment 441

The conjugated antisense compound of any of embodiments 430-440, wherein the target nucleic acid is expressed in the liver.

Embodiment 442

The conjugated antisense compound of embodiment 441, wherein the target nucleic acid is expressed in hepatocytes.

Embodiment 443

The conjugated antisense compound of embodiment 441 or 442, wherein the target nucleic acid encodes a protein selected from among: Androgen Receptor, Apolipoprotein (a), Apolipoprotein B, Apolipoprotein C-III, C-Reactive Protein, eIF-4E, Factor VII, Factor XI, Glucocorticoid Receptor, Glucagon Receptor, Protein Tyrosine Phosphatase 1B, STAT3, and Transthyretin.

Embodiment 444

The conjugated antisense compound of embodiment 430-440 wherein the target nucleic acid is a viral nucleic acid.

Embodiment 445

The conjugated antisense compound of embodiment 444, wherein the viral nucleic acid expressed in the liver.

Embodiment 446

The conjugated antisense compound of embodiment 445, wherein the target nucleic acid is a Hepatitis B viral nucleic acid.

Embodiment 447

The conjugated antisense compound of any of embodiments 229-443, wherein the antisense oligonucleotide comprises the nucleobase sequence of any one of SEQ ID NOs.: 17, 18, 19, 20, 21, 22, 23, or 24.

Embodiment 448

The conjugated antisense compound of any of embodiments 229-443, wherein the antisense oligonucleotide comprises the nucleobase sequence of any one of SEQ ID NO.: 25, 26, 27, 28, 29, or 30.

Embodiment 449

The conjugated antisense compound of any of embodiments 229-443, wherein the antisense oligonucleotide comprises the nucleobase sequence of SEQ ID NO.: 31.

Embodiment 450

The conjugated antisense compound of any of embodiments 229-443, wherein the antisense oligonucleotide comprises the nucleobase sequence of SEQ ID NO.: 32.

Embodiment 451

The conjugated antisense compound of any of embodiments 229-443, wherein the antisense oligonucleotide comprises the nucleobase sequence of SEQ ID NO.: 33.

Embodiment 452

The conjugated antisense compound of any of embodiments 229-443, wherein the antisense oligonucleotide comprises the nucleobase sequence of SEQ ID NO.: 34.

Embodiment 453

The conjugated antisense compound of any of embodiments 229-443, wherein the antisense oligonucleotide comprises the nucleobase sequence of any of SEQ ID NOs.: 35, 36, 37, 38, 39, 40, 41, 42, or 43.

Embodiment 454

The conjugated antisense compound of any of embodiments 229-443, wherein the antisense oligonucleotide comprises the nucleobase sequence of SEQ ID NO.: 44, 45, 46, 47, or 48.

Embodiment 455

The conjugated antisense compound of any of embodiments 229-443, wherein the antisense oligonucleotide comprises the nucleobase sequence of any of SEQ ID NOs.: 49, 50, 51, 52, 53, 54, 55, 56, 57, 58, or 59.

Embodiment 456

The conjugated antisense compound of any of embodiments 229-443, wherein the antisense oligonucleotide comprises the nucleobase sequence of any of SEQ ID NOs.: 60, 61, 62, 63, 64, 65, 66, or 67.

Embodiment 457

The conjugated antisense compound of any of embodiments 229-443, wherein the antisense oligonucleotide comprises the nucleobase sequence of any of SEQ ID NO.: 69, 70, 71, or 72.

Embodiment 458

The conjugated antisense compound of any of embodiments 229-443, wherein the antisense oligonucleotide comprises the nucleobase sequence of SEQ ID NO.: 73.

Embodiment 459

The conjugated antisense compound of any of embodiments 229-443, wherein the antisense oligonucleotide comprises the nucleobase sequence of any of SEQ ID NOs.: 74, 75, 76, 77, 78, 79, 80, or 81.

Embodiment 460

The conjugated antisense compound of any of embodiments 229-443, wherein the antisense oligonucleotide comprises the nucleobase sequence of SEQ ID NO.: 68.

Embodiment 461

The conjugated antisense compound of any of embodiments 229-443, wherein the antisense oligonucleotide comprises the nucleobase sequence of any of SEQ ID NOs.: 82-103.

Embodiment 462

A method of reducing the amount or activity of a target nucleic acid in a cell, comprising contacting a cell with the conjugated antisense compound of any of embodiments 229-461.

Embodiment 463

The method of embodiment 462, wherein the cell is a liver cell.

Embodiment 464

The method of embodiment 462, wherein the cell is a hepatocyte.

Embodiment 465

The method of any of embodiments 462-464 wherein the cell is in vitro.

Embodiment 466

The method of any of embodiments 462-464 wherein the cell is in an animal.

Embodiment 467

The method of embodiment 466 wherein the animal is a mouse.

Embodiment 468

The method of embodiment 466 wherein the animal is a human.

Embodiment 469

A pharmaceutical composition comprising an conjugated antisense compound according to any of embodiments 229-469 and a pharmaceutically acceptable carrier or diluent.

Embodiment 470

The pharmaceutical composition of embodiment 469 wherein the pharmaceutically acceptable carrier or diluent is selected from among sterile water and sterile saline.

Embodiment 471

A method of treating a disease or condition in an animal comprising administering the pharmaceutical composition of embodiment 469 or 470 to the animal and thereby treating the disease or condition in the animal.

Embodiment 472

The method of embodiment 471 wherein the animal is a mouse.

Embodiment 473

The method of embodiment 471 wherein the animal is a human.

Embodiment 474

The method of any of embodiments 471-473, wherein the disease or condition is a liver disease or condition.

Embodiment 475

The method of any of embodiments 471-474 wherein the administration is parenteral.

Embodiment 476

The method embodiment 475 wherein the administration is by subcutaneous injection.

Embodiment 477

The method of embodiment 475 wherein the administration is by intravenous injection.

Embodiment 478

The method of embodiment 475 wherein the administration is by intramuscular injection.

Embodiment 479

The method of any of embodiments 471-478 wherein the conjugated antisense compound is provided at a dose of 1-10 mg/kg.

Embodiment 480

The method of any of embodiments 471-478 wherein the conjugated antisense compound is provided at a dose of less than 1 mg/kg.

Embodiment 481

The method of any of embodiments 471-480 wherein the conjugated antisense compound is provided at a dose of greater than 10 mg/kg.

Embodiment 482

The method of any of embodiments 471-481 wherein the conjugated antisense compound is provided for a dosing period of at least 2 months.

Embodiment 483

The method of any of embodiments 471-481 wherein the conjugated antisense compound is provided for a dosing period of at least 4 months.

Embodiment 484

The method of any of embodiments 471-481 wherein the conjugated antisense compound is provided for a dosing period of at least 6 months.

Embodiment 485

The method of any of embodiments 471-481 wherein the conjugated antisense compound is provided at a dosing frequency of about one dose every week.

Embodiment 486

The method of any of embodiments 471-481 wherein the conjugated antisense compound is provided at a dosing frequency of about one dose every two weeks.

Embodiment 487

The method of any of embodiments 471-481 wherein the conjugated antisense compound is provided at a dosing frequency of about one dose every three weeks.

Embodiment 488

The method of any of embodiments 471-481 wherein the conjugated antisense compound is provided at a dosing frequency of one dose every four weeks.

Embodiment 489

The method of any of embodiments 471-481 wherein the conjugated antisense compound is provided at a dosing frequency of one dose every five weeks.

Embodiment 490

The method of any of embodiments 471-481 wherein the conjugated antisense compound is provided at a dosing frequency of one dose every six weeks.

Embodiment 491

The method of any of embodiments 471-481 wherein the conjugated antisense compound is provided at a dosing frequency of one dose every seven weeks.

Embodiment 492

The method of any of embodiments 471-481 wherein the conjugated antisense compound is provided at a dosing frequency of one dose every eight weeks.

Embodiment 493

A conjugate compound comprising at least one phosphorus linking group or neutral linking group and one or more ligands.

Embodiment 494

The conjugate compound of embodiment 493 comprising two or more ligands.

Embodiment 495

The conjugate compound of embodiment 493 comprising three ligands.

Embodiment 496

The conjugate compound of any of embodiments 493 to 495, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, 13-D-Mannofuranose, α-D-Mannopyranose, β-D-Mannopyranose, α-D-Glucopyranose, β-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 497

The conjugate compound of any of embodiments 493 to 495, wherein the ligand is N-acetyl galactoseamine Embodiment 498

The conjugate compound of any of embodiments 493 to 497, wherein conjugate group comprises a structure selected from among:

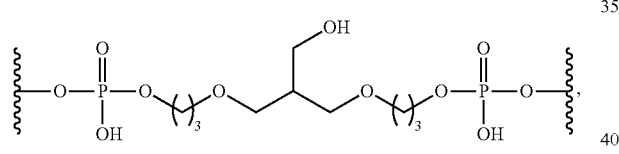

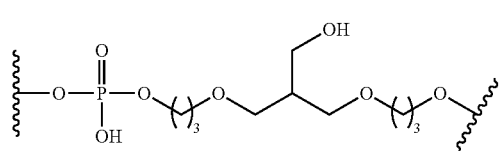

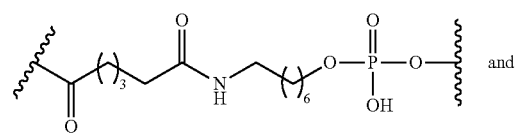

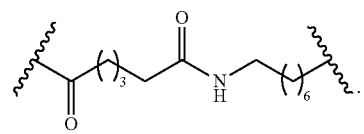

Embodiment 499

The conjugate compound of any of embodiments 493 to 498, wherein the conjugate compound has a tether having a structure selected from among:

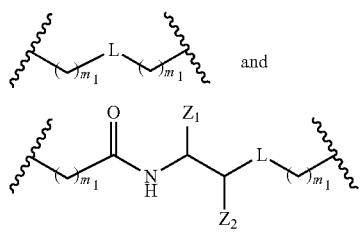

wherein L is either a phosphorus linking group or a neutral linking group;

$Z_1$ is $C(=O)O-R_2$;

$Z_2$ is H, $C_1$-$C_6$ alkyl or substituted $C_1$-$C_6$ alky;

$R_2$ is H, $C_1$-$C_6$ alkyl or substituted $C_1$-$C_6$ alky; and each $m_1$ is, independently, from 0 to 20 wherein at least one $m_1$ is greater than 0 for each tether.

Embodiment 500

The conjugate compound of embodiment 499, wherein the tether has a structure selected from among:

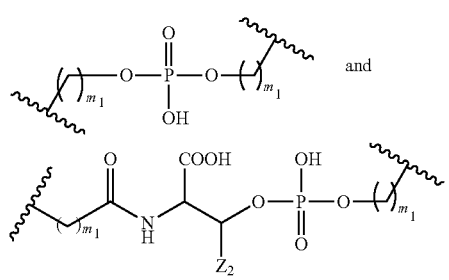

wherein $Z_2$ is H or $CH_3$; and each $m_1$ is, independently, from 0 to 20 wherein at least one $m_1$ is greater than 0 for each tether.

Embodiment 501

The conjugate compound of any of embodiments 493 to 500, wherein the conjugate compound is covalently attached to an oligonucleotide.

Embodiment 502

An oligomeric compound comprising an oligonucleotide at least one conjugate group, wherein the at least one conjugate group is a conjugate compound of any of embodiments 493 to 500.

Embodiment 503
A compound having the formula (I):
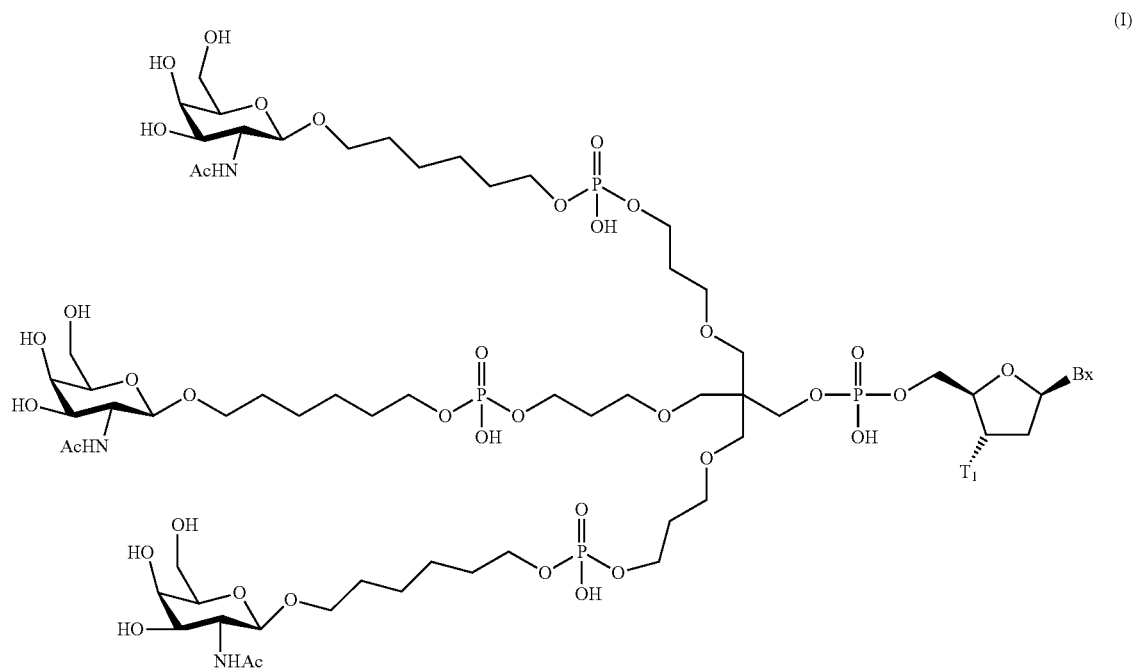
wherein:
  Bx is a heterocyclic base moiety; and
  $T_1$ is a hydroxyl, hydrogen, a hydroxyl protecting group, phosphorus moiety, or a reactive phosphorus group.
Embodiment 504
A compound having the formula (II):
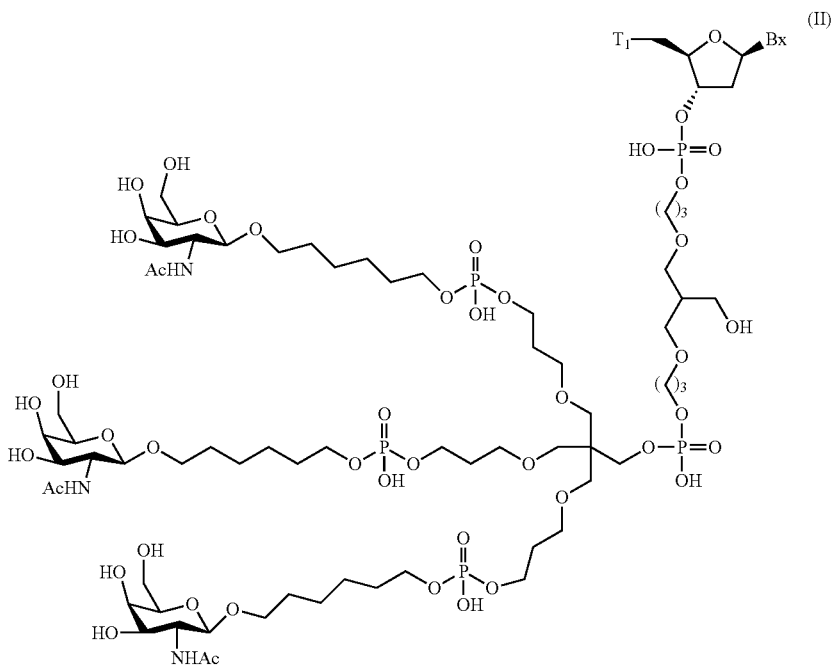

wherein:

Bx is a heterocyclic base moiety; and

T₁ is a hydroxyl, hydrogen, a hydroxyl protecting group, phosphorus moiety, or a reactive phosphorus group.

Embodiment 505

The compound of any of embodiment 503 or 504, wherein said phosphorus moiety has the formula:

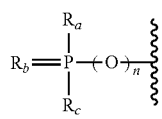

wherein:

n is 0 or 1;

$R_a$ and $R_c$ are each, independently, OH, SH, $C_1$-$C_6$ alkyl, substituted $C_1$-$C_6$ alkyl, $C_1$-$C_6$ alkoxy, substituted $C_1$-$C_6$ alkoxy, amino or substituted amino; and $R_b$ is O or S.

Embodiment 506

An oligomeric compound comprising an oligonucleotide and at least one conjugate group, wherein the at least one conjugate group is a conjugate compound of formula (III):

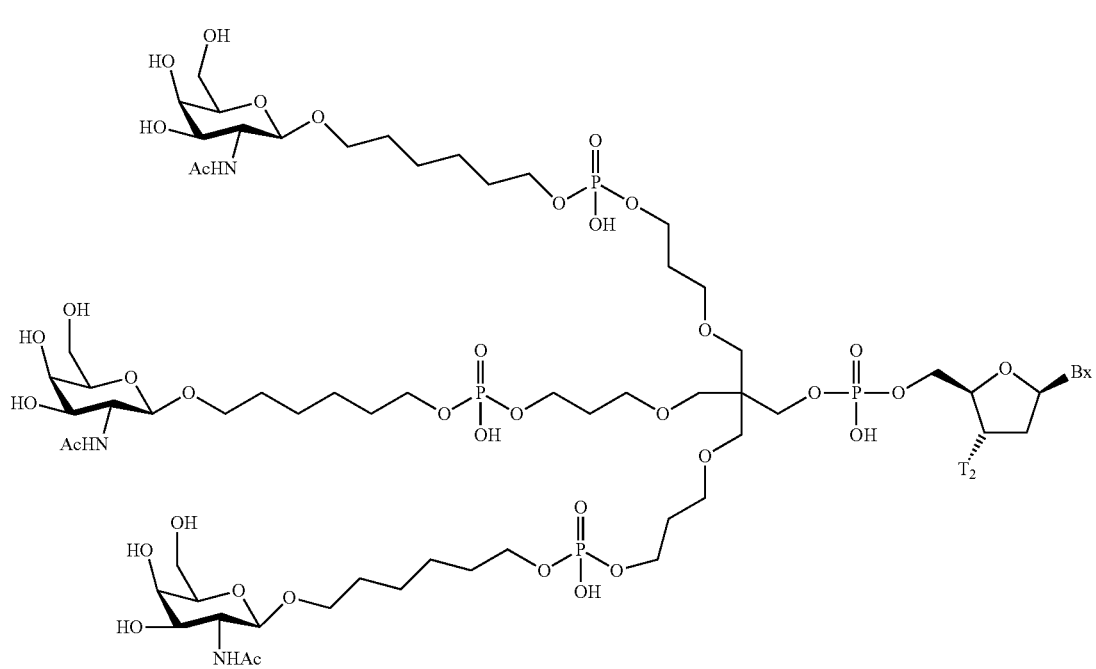

(III)

wherein:

Bx is a heterocyclic base moiety; and

T₂ is an internucleoside linking group attached to a nucleoside, a nucleotide, an oligonucleoside, an oligonucleotide, a monomeric subunit or an oligomeric compound.

Embodiment 507

An oligomeric compound comprising an oligonucleotide and at least one conjugate group, wherein the at least one conjugate group is a conjugate compound of formula (IV):

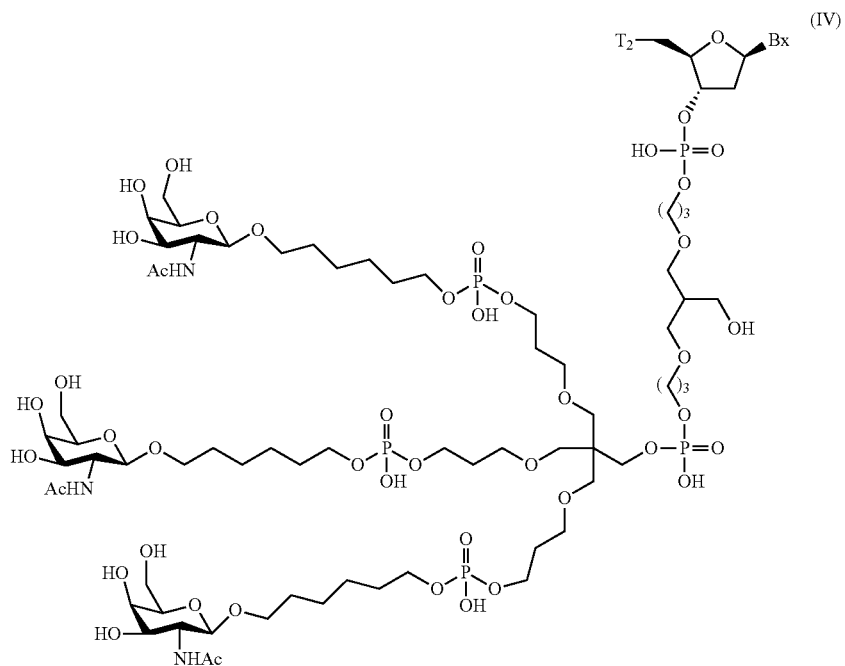

wherein:
Bx is a heterocyclic base moiety; and
T₂ is an internucleoside linking group attached to a nucleoside, a nucleotide, an oligonucleoside, an oligonucleotide, a monomeric subunit or an oligomeric compound.

Embodiment 508

The compound or oligomeric compound of any of embodiments 503 to 507, wherein the heterocyclic base moiety is a pyrimidine, substituted pyrimidine, purine or substituted purine.

Embodiment 509

The compound or oligomeric compound of any of embodiments 503 to 507, wherein Bx is uracil, thymine, cytosine, 5-methyl cytosine, adenine, or guanine.

Embodiment 510

The compound or oligomeric compound of any of embodiments 503 to 507, wherein Bx is adenine.

Embodiment 511

A conjugated antisense compound, wherein the compound has a structure represented by the formula:

$$A—B—C—D—(E—F)_q$$

wherein
A is the antisense oligonucleotide;
B is the cleavable moiety
C is the conjugate linker
D is the branching group
each E is a tether;
each F is a ligand; and
q is an integer between 1 and 5.

Embodiment 512

A conjugated antisense compound, wherein the compound has a structure represented by the formula:

$$A—B—(C)_{n_1}—D—(E—F)_q$$

wherein:
A is the antisense oligonucleotide;
B is the cleavable moiety
C is the conjugate linker
D is the branching group
each E is a tether;
each F is a ligand;
$n_1$ is 0 or 1; and
q is an integer between 1 and 5.

Embodiment 513

The conjugated antisense compound of embodiment 511 or 512, wherein the conjugate linker has a structure selected from among:

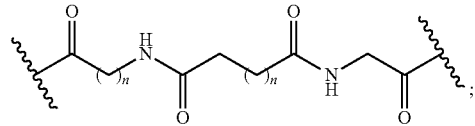

129
-continued
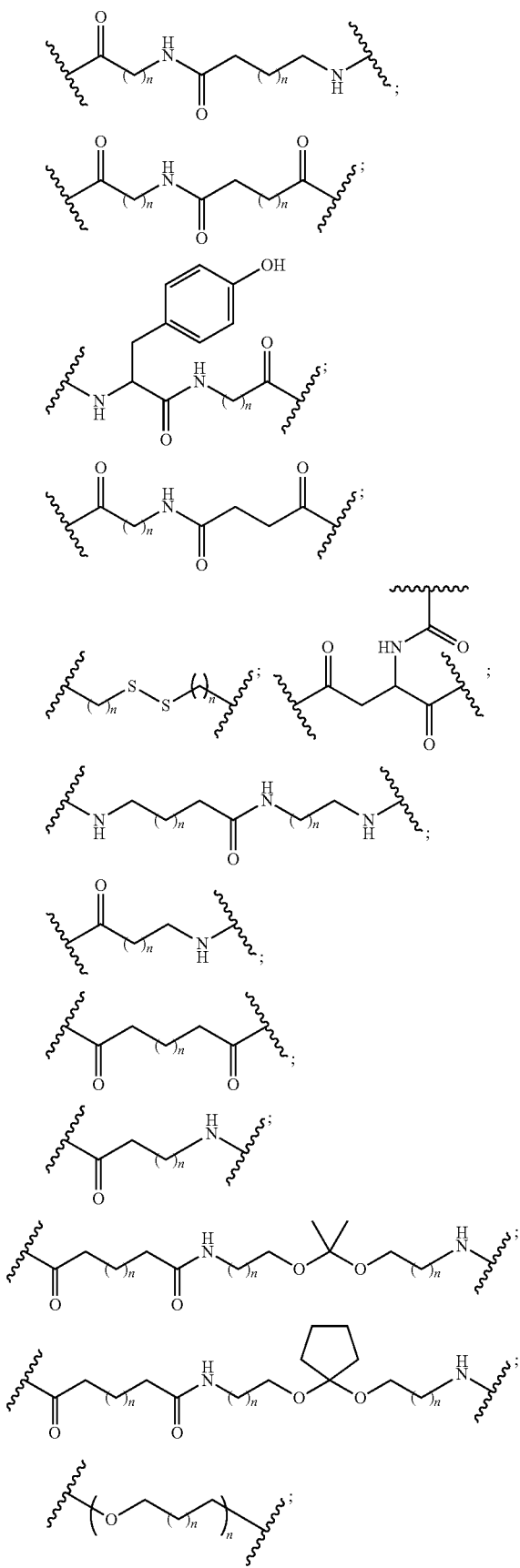
130
-continued
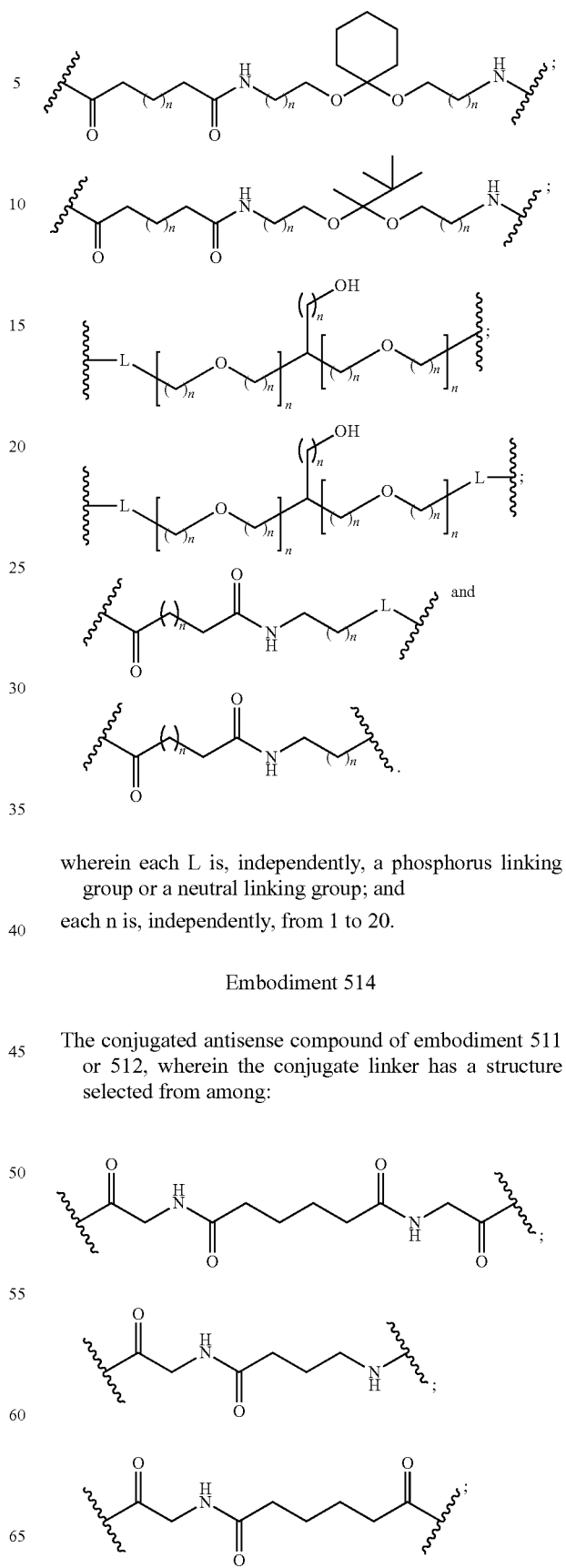
wherein each L is, independently, a phosphorus linking group or a neutral linking group; and
each n is, independently, from 1 to 20.
Embodiment 514
The conjugated antisense compound of embodiment 511 or 512, wherein the conjugate linker has a structure selected from among:
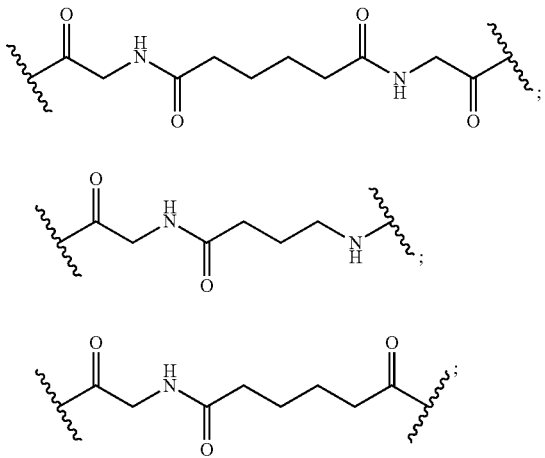

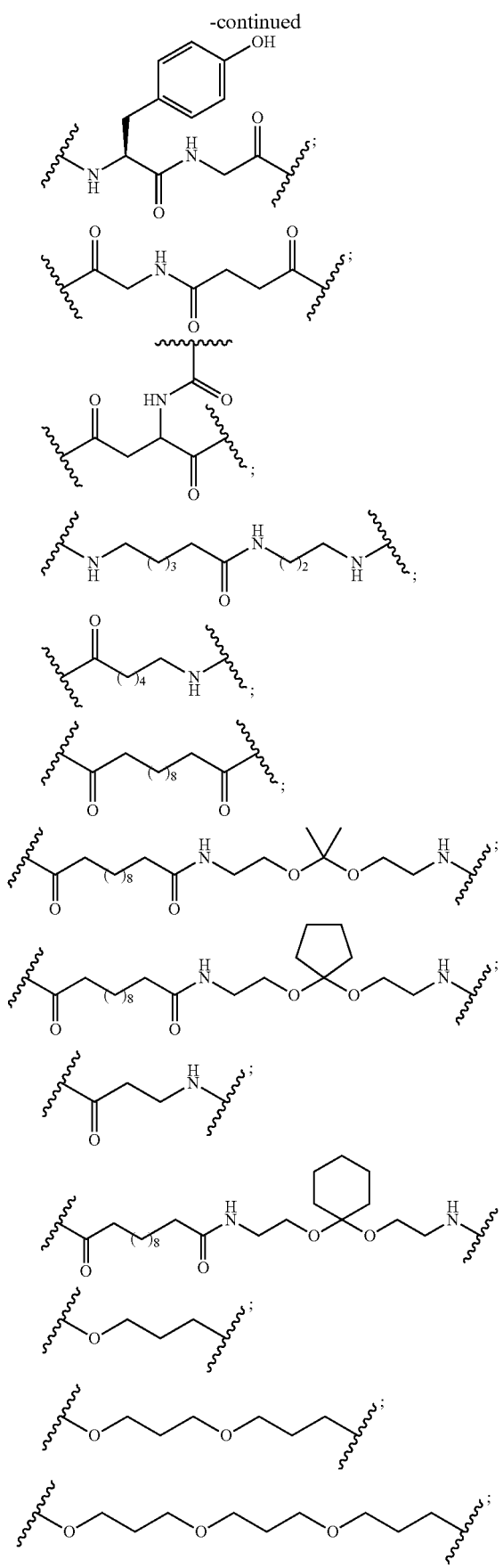
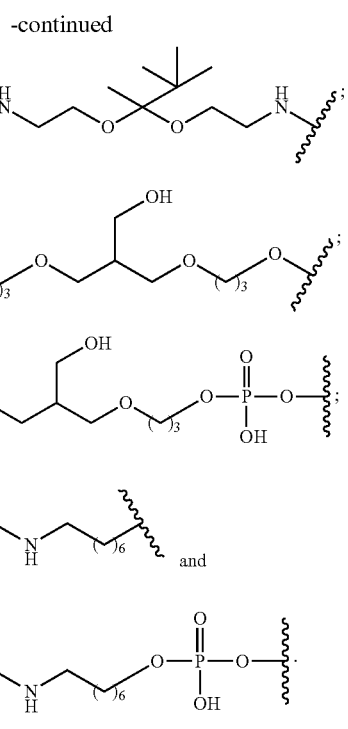
Embodiment 515
The conjugated antisense compound of embodiment 511 or 512, wherein the conjugate linker has the structure:
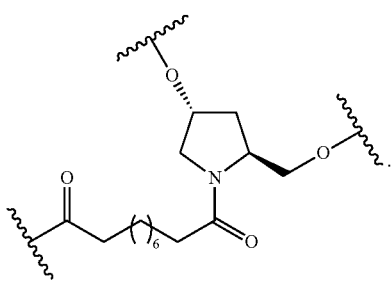
Embodiment 516
The conjugated antisense compound of embodiment 511 or 512, wherein the conjugate linker has one of the structures selected from:
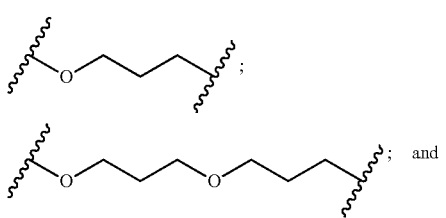

133
-continued

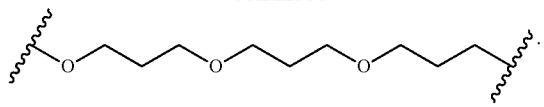

Embodiment 517

The conjugated antisense compound of embodiment 511 or 512, wherein the conjugate linker has one of the structures selected from:

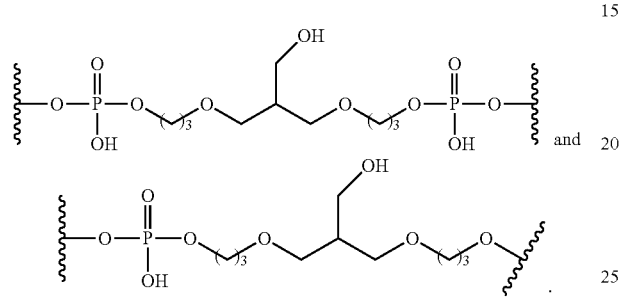

Embodiment 518

The conjugated antisense compound of embodiment 511 or 512, wherein the conjugate linker has one of the structures selected from:

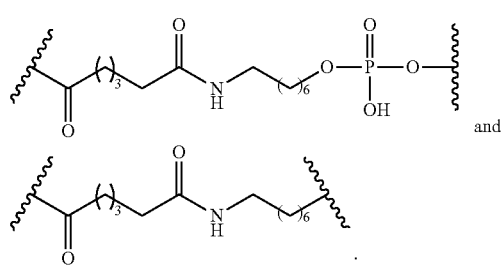

Embodiment 519

The conjugated antisense compound of any of embodiments 511 or 518, wherein the conjugate linker comprises a pyrrolidine.

Embodiment 520

The conjugated antisense compound of any of embodiments 511 or 519, wherein the conjugate linker does not comprise a pyrrolidine.

Embodiment 521

The conjugated antisense compound of any of embodiments 511 or 520, wherein the conjugate linker comprises PEG.

134

Embodiment 522

The conjugated antisense compound of any of embodiments 511 or 521, wherein the conjugate linker comprises an amide.

Embodiment 523

The conjugated antisense compound of any of embodiments 511 or 522, wherein the conjugate linker does not comprise an amide.

Embodiment 524

The conjugated antisense compound of any of embodiments 511 or 523, wherein the conjugate linker comprises a polyamide.

Embodiment 525

The conjugated antisense compound of any of embodiments 511 or 524, wherein the conjugate linker comprises an amine

Embodiment 526

The conjugated antisense compound of any of embodiments 511 or 525, wherein the conjugate linker comprises one or more disulfide bonds.

Embodiment 527

The conjugated antisense compound of any of embodiments 511 or 526, wherein the conjugate linker comprises a protein binding moiety.

Embodiment 528

The conjugated antisense compound of embodiment 527, wherein the protein binding moiety comprises a lipid.

Embodiment 529

The conjugated antisense compound of embodiment 528, wherein the protein binding moiety is selected from among: cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid.

Embodiment 530

The conjugated antisense compound of any of embodiments 527 to 529 wherein the protein binding moiety is a C16 to C22 long chain saturated or unsaturated fatty acid, cholesterol, cholic acid, vitamin E, adamantane or 1-pentafluoropropyl.

Embodiment 531
The conjugated antisense compound of any of embodiments 511 to 512 wherein the conjugate linker has a structure selected from among:
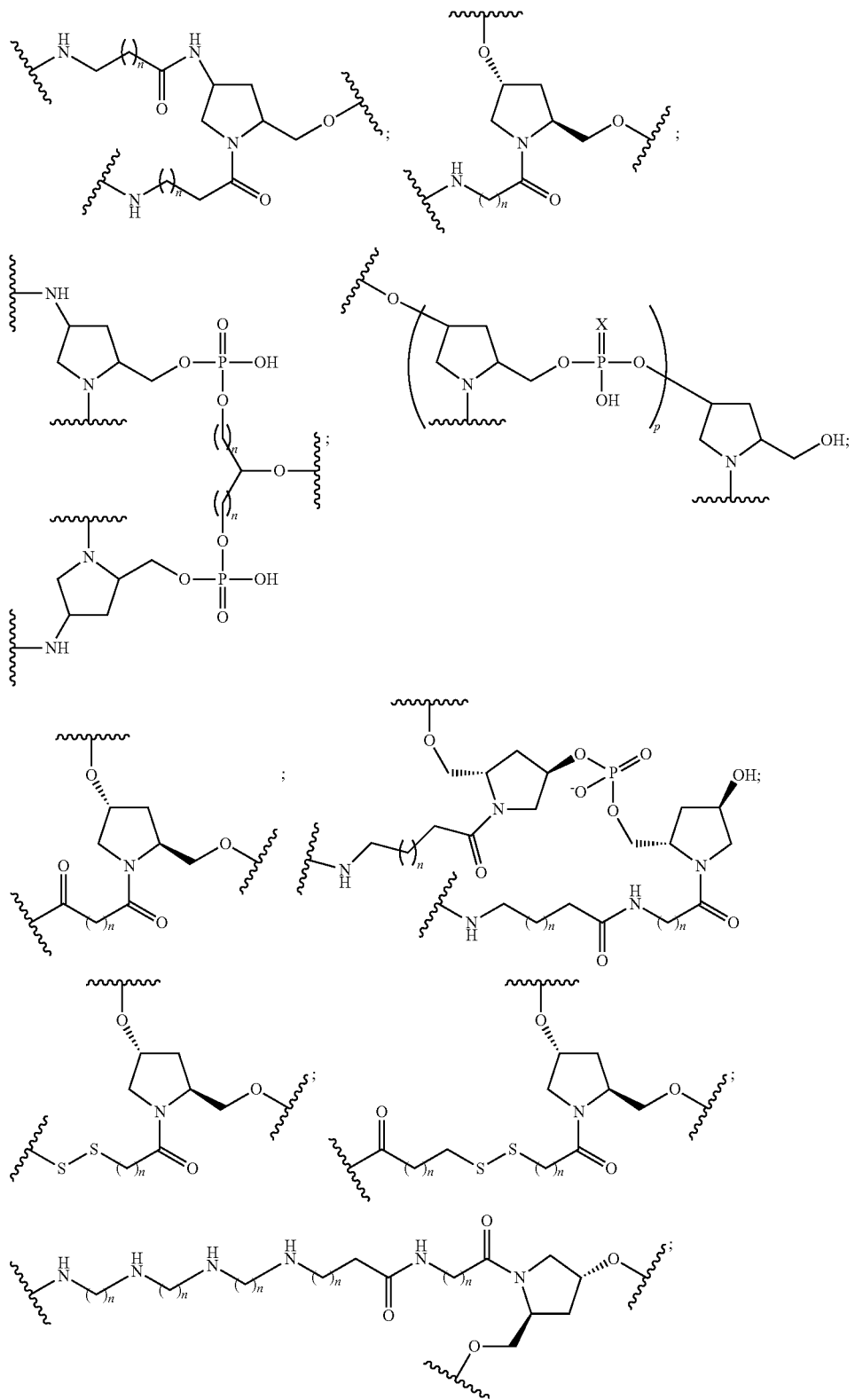

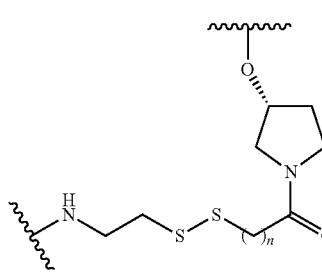
wherein each n is, independently, is from 1 to 20; and p is from 1 to 6.
Embodiment 532
The conjugated antisense compound of any of embodiments 511 to 512 wherein the conjugate linker has a structure selected from among:

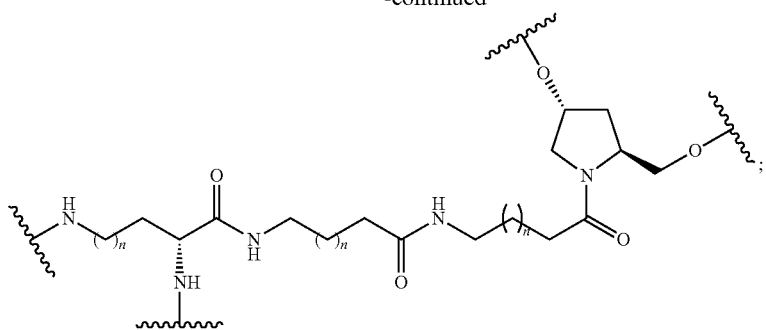
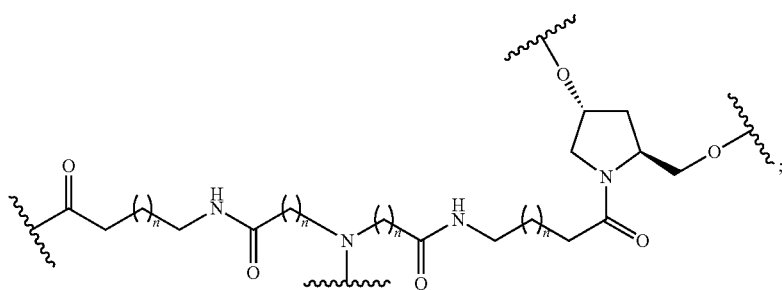
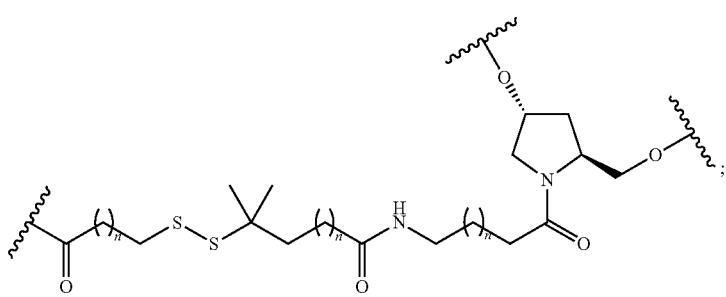
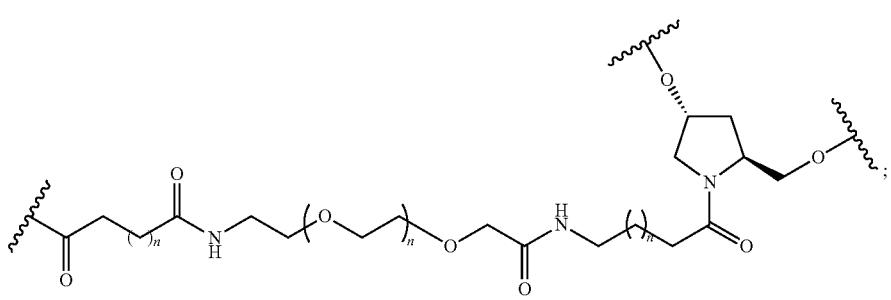
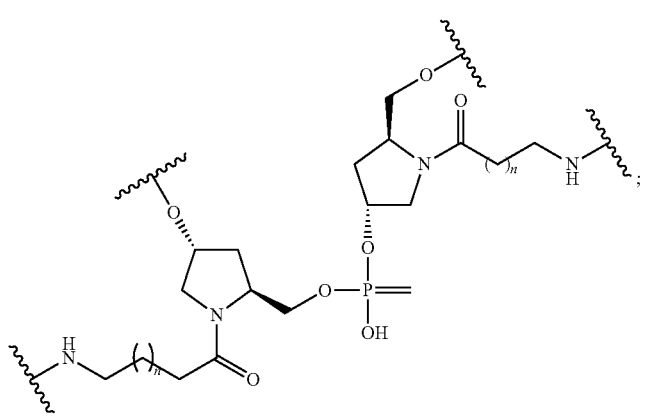

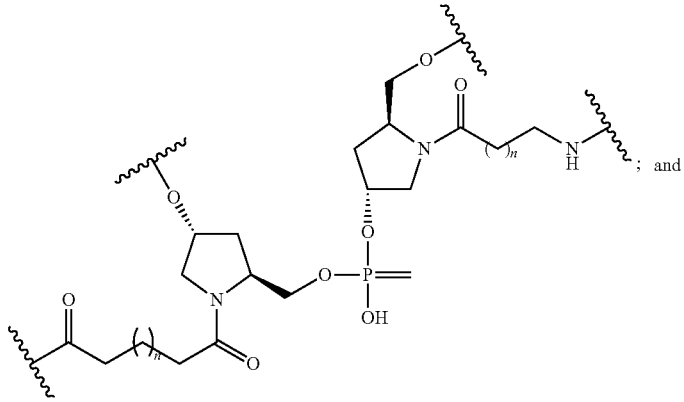
; and
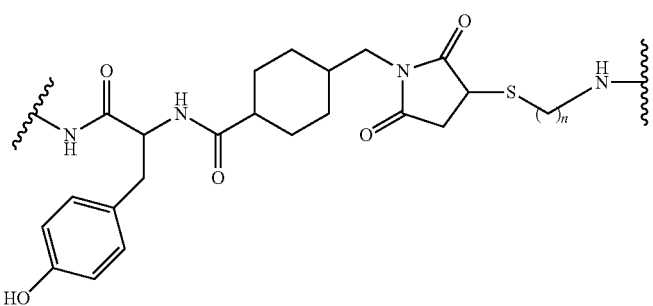
wherein each n is, independently, from 1 to 20.
Embodiment 533
The conjugated antisense compound of any of embodiments 511 to 512 wherein the conjugate linker has a structure selected from among:
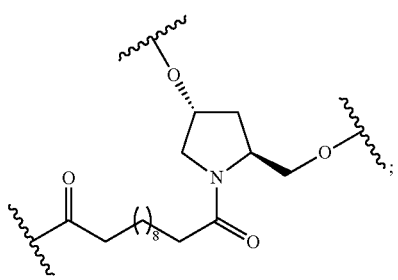
;
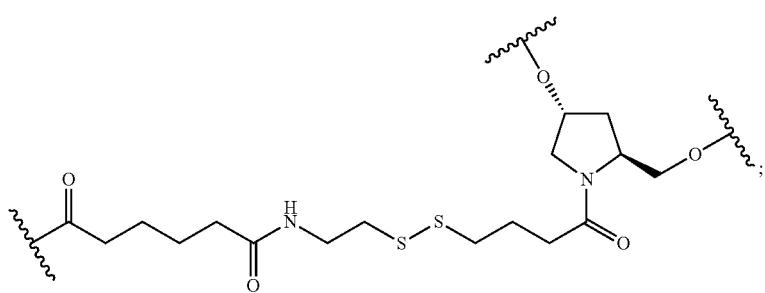
;

143
-continued
144
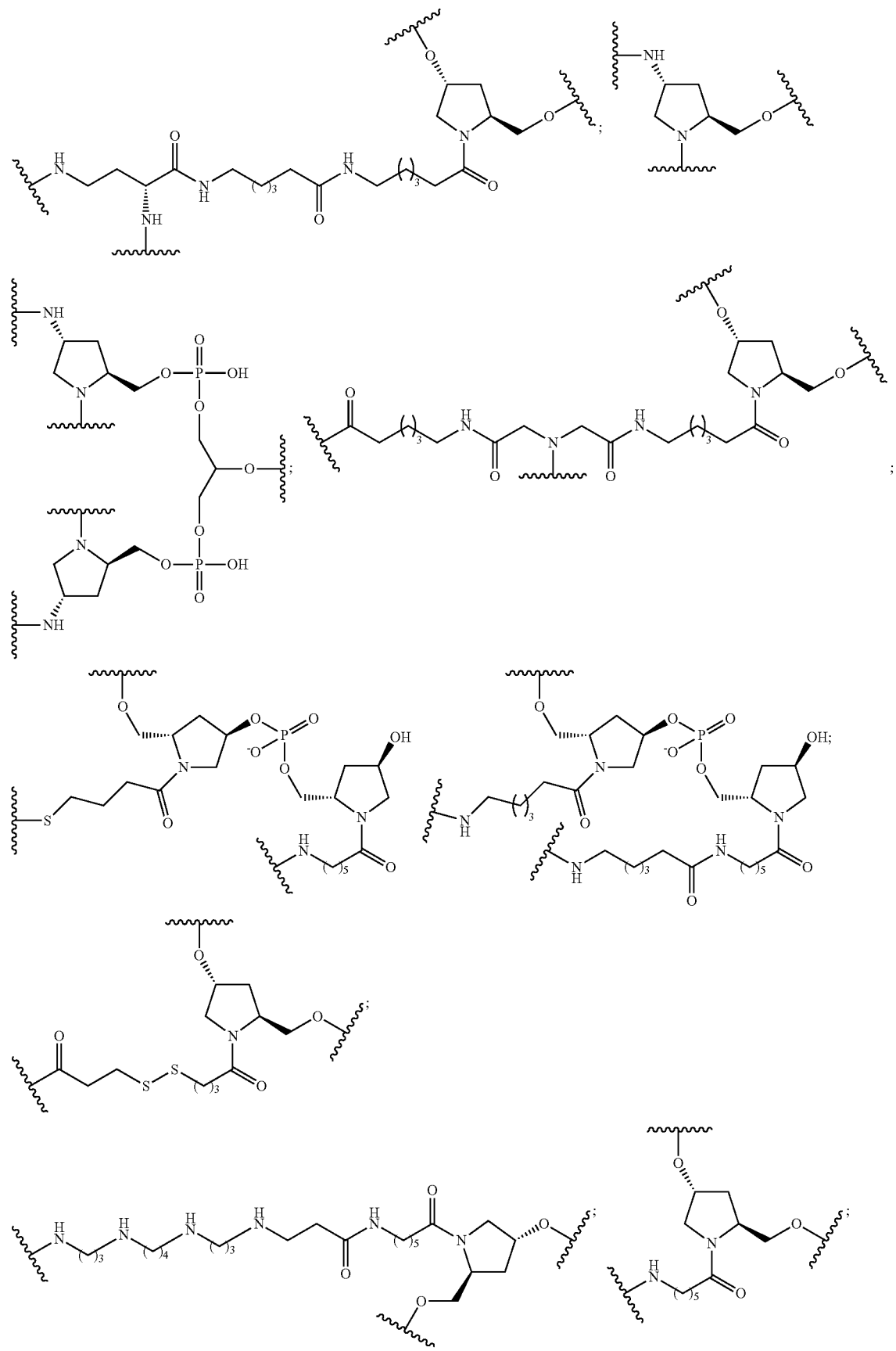

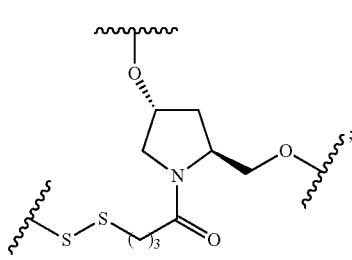 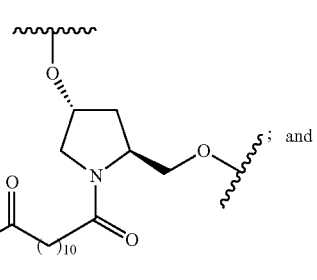

-continued

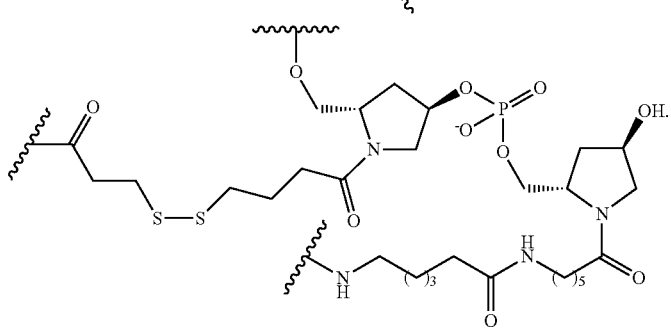

Embodiment 534

The conjugated antisense compound of any of embodiments 511 to 512 wherein the conjugate linker has a structure selected from among:

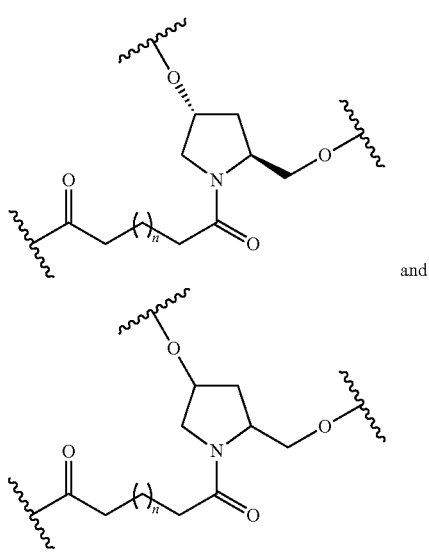

wherein n is from 1 to 20.

Embodiment 535

A conjugated antisense compound, wherein the compound has a structure represented by the formula:

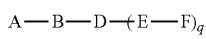

wherein
A is the antisense oligonucleotide;
B is the cleavable moiety;
D is the branching group;
each E is a tether;
each F is a ligand; and
q is an integer between 1 and 5.

Embodiment 536

A conjugated antisense compound, wherein the compound has a structure represented by the formula:

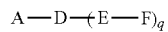

wherein
A is the antisense oligonucleotide;
D is the branching group;
each E is a tether;
each F is a ligand; and
q is an integer between 1 and 5.

Embodiment 537

The conjugated antisense compound of embodiment 511 to 536, wherein the branching group has one of the following structures:

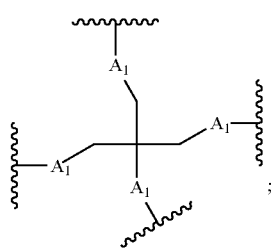

-continued

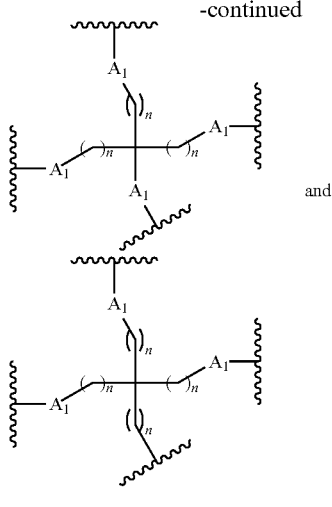
and wherein each $A_1$ is independently, O, S, C=O or NH; and each n is, independently, from 1 to 20.

Embodiment 538

The conjugated antisense compound of embodiment 511 to 536, wherein the branching group has one of the following structures:

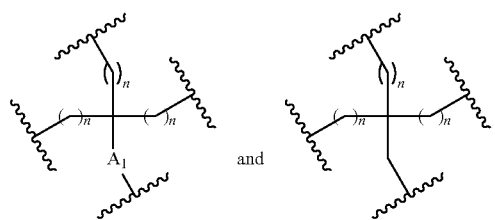

wherein each $A_1$ is independently, O, S, C=O or NH; and each n is, independently, from 1 to 20.

Embodiment 539

The conjugated antisense compound of embodiment 511 to 536, wherein the branching group has the following structure:

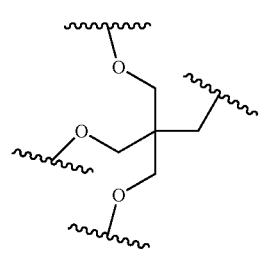

Embodiment 540

The conjugated antisense compound of embodiment 511 to 536, wherein the branching group has the following structure:

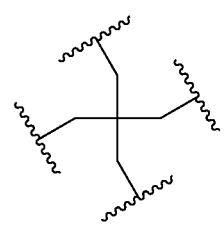

Embodiment 541

The conjugated antisense compound of any of embodiments 511 to 536, wherein the branching group comprises an ether.

Embodiment 542

The conjugated antisense compound of embodiment 511 to 536, wherein the branching group has the following structure:

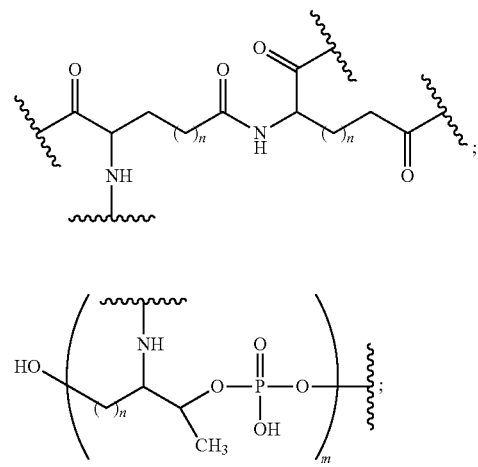

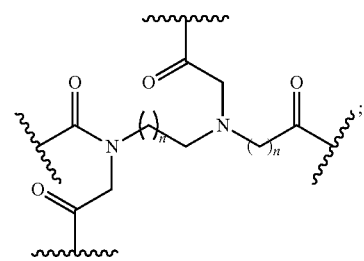

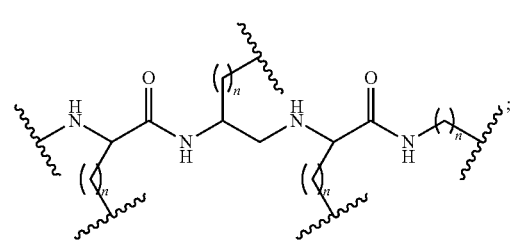

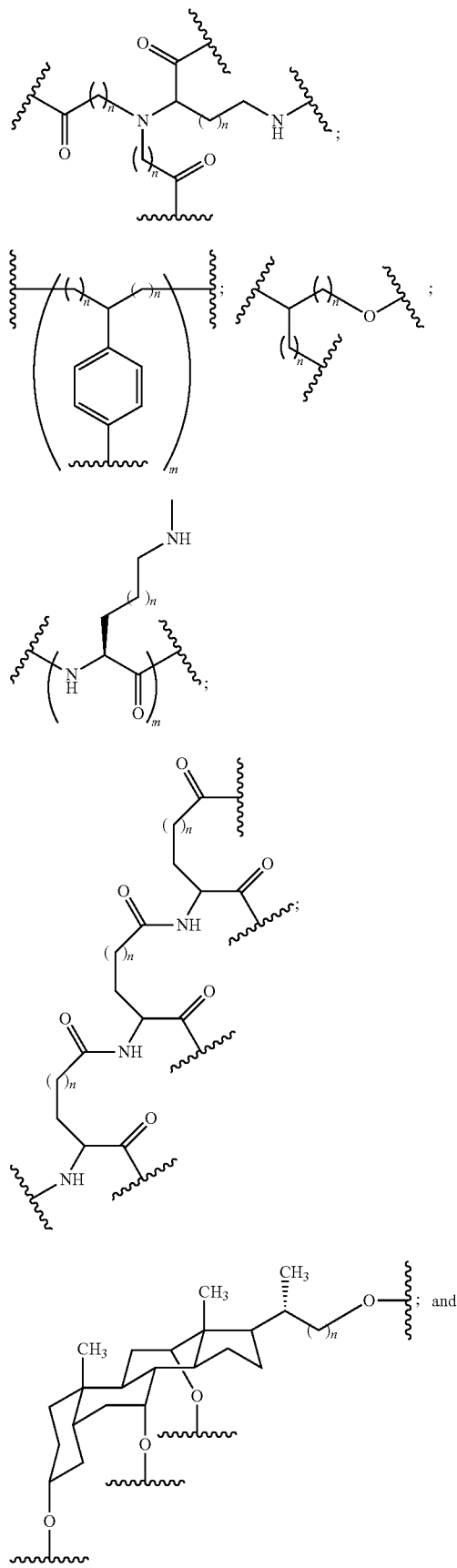
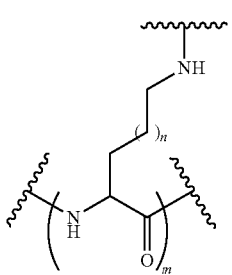
each n is, independently, from 1 to 20; and
m is from 2 to 6.
Embodiment 543
The conjugated antisense compound of embodiment 511 to 536, wherein the branching group has the following structure:
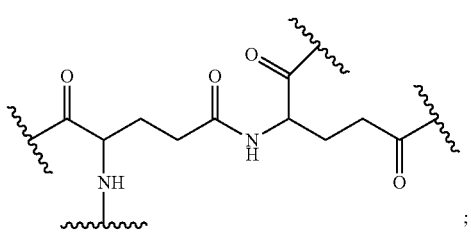
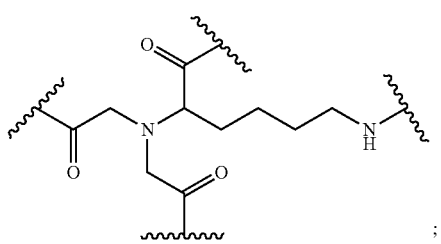
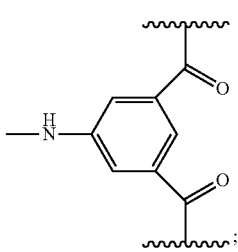
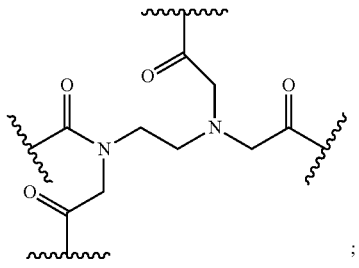

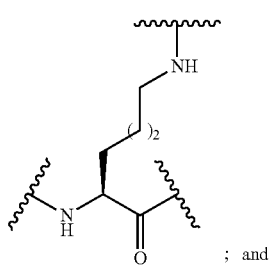
; and
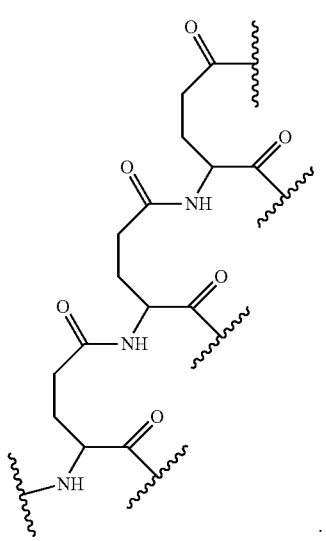 [SMILES: *NC(CCC(=O)NC(CCC(=O)NC(CCC(*)=O)C(*)=O)C(*)=O)C(*)=O]
Embodiment 544
The conjugated antisense compound of embodiment 511 to 536, wherein the branching group has the following structure:
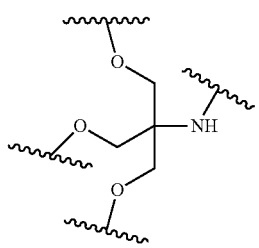
Embodiment 545
The conjugated antisense compound of any of embodiments 511 to 536, wherein the branching group comprises:
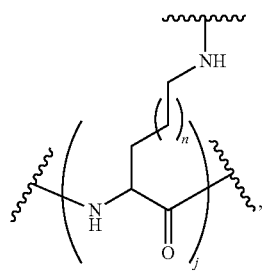
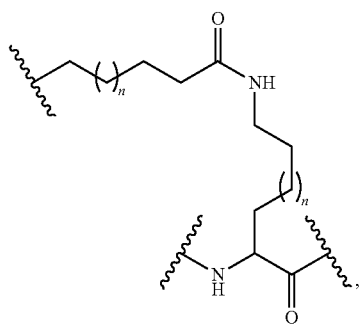
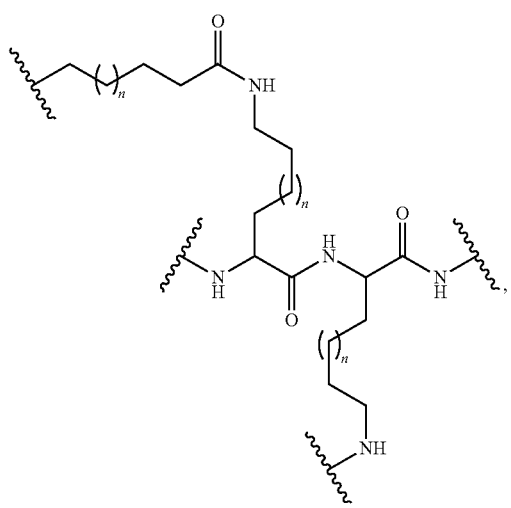
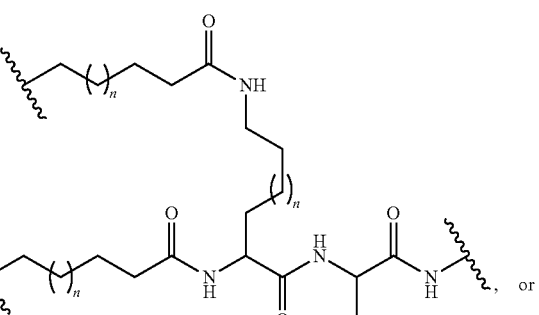
, or

153
-continued
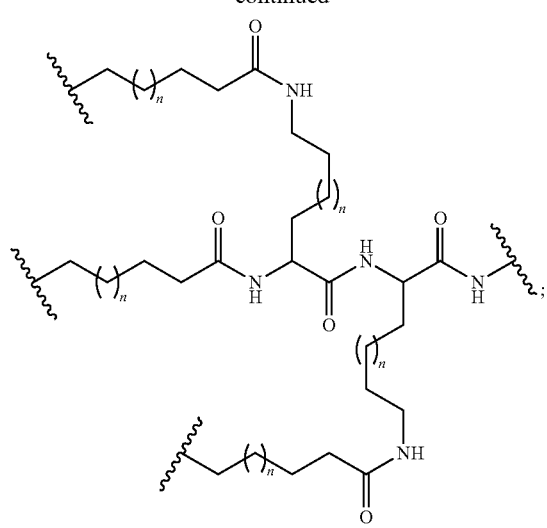
wherein each j is an integer from 1 to 3; and
wherein each n is an integer from 1 to 20.
Embodiment 546
The conjugated antisense compound of any of embodiments 511 to 536 wherein the branching group comprises:
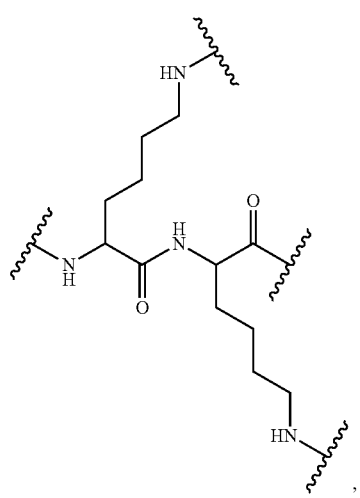
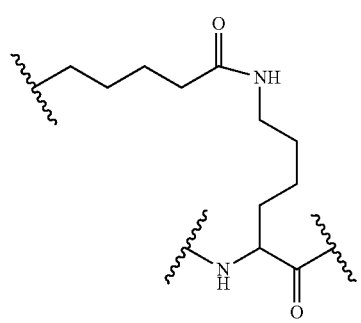
154
-continued
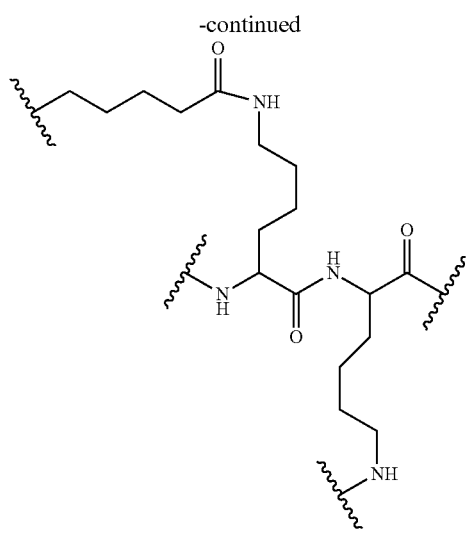
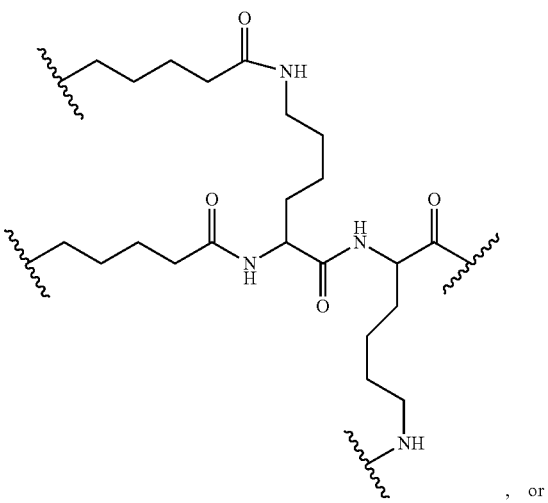
, or
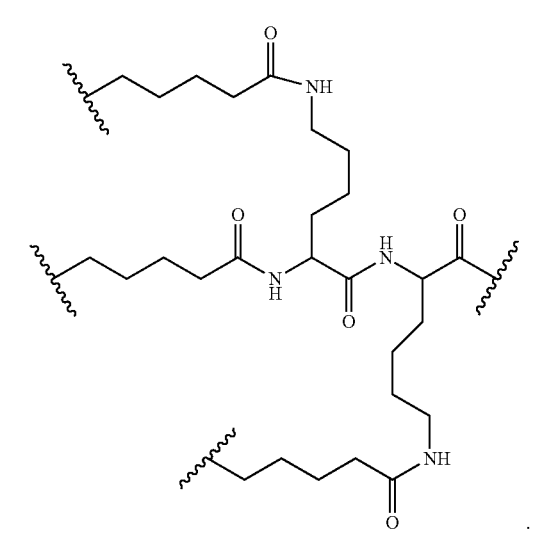
Embodiment 547
The conjugated antisense compound of embodiment 511 to 546, wherein each tether is selected from among:

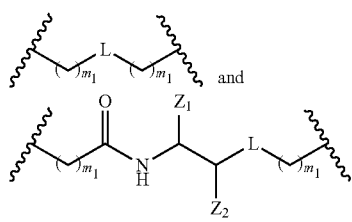 and wherein L is selected from a phosphorus linking group and a neutral linking group;
$Z_1$ is C(=O)O—$R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

Embodiment 548

The conjugated antisense compound of embodiment 511 to 546, wherein each tether is selected from among:

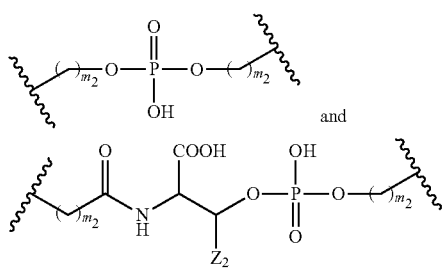

wherein $Z_2$ is H or $CH_3$; and
each $m_2$ is, independently, from 0 to 20 wherein at least one $m_2$ is greater than 0 for each tether.

Embodiment 549

The conjugated antisense compound of any of embodiments 511 to 546, wherein at least one tether comprises PEG.

Embodiment 550

The conjugated antisense compound of any of embodiments 511 to 546, wherein at least one tether comprises an amide.

Embodiment 551

The conjugated antisense compound of any of embodiments 511 to 546, wherein at least one tether comprises a polyamide.

Embodiment 552

The conjugated antisense compound of any of embodiments 511 to 546, wherein at least one tether comprises an amine Embodiment 553

The conjugated antisense compound of any of embodiments 511 to 546, wherein at least two tethers are different from one another.

Embodiment 554

The conjugated antisense compound of any of embodiments 511 to 546, wherein all of the tethers are the same as one another.

Embodiment 555

The conjugated antisense compound of any of embodiments 511 to 546, wherein each tether is selected from among:

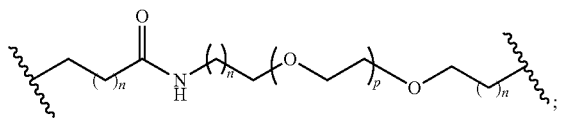

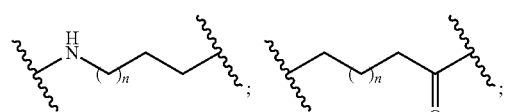

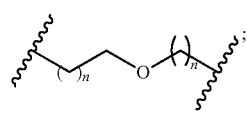

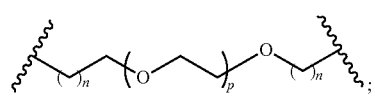

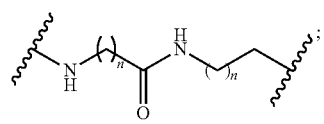

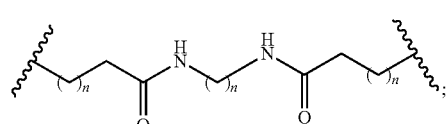

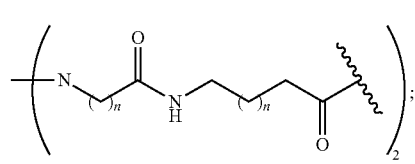

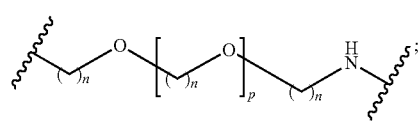

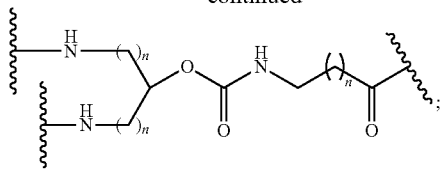

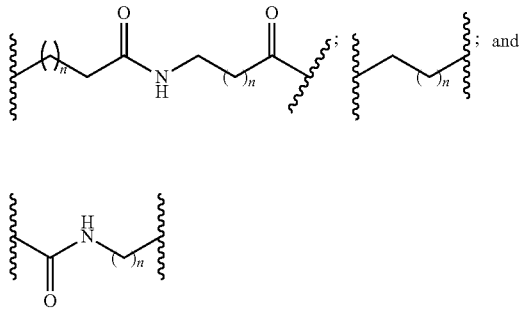

wherein each n is, independently, from 1 to 20; and each p is from 1 to about 6.

Embodiment 556

The conjugated antisense compound of any of embodiments 511 to 546, wherein each tether is selected from among:

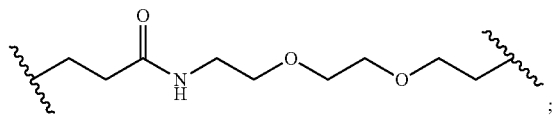

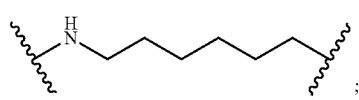

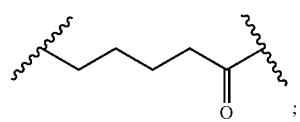

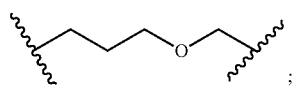

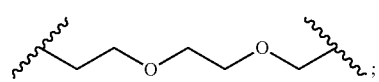

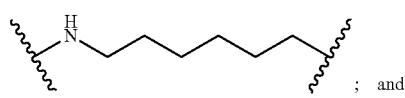

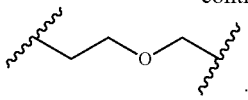

Embodiment 557

The conjugated antisense compound of any of embodiments 511 to 546, wherein each tether has the following structure:

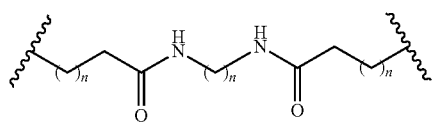

wherein each n is, independently, from 1 to 20.

Embodiment 558

The conjugated antisense compound of any of embodiments 511 to 546, wherein each tether has the following structure:

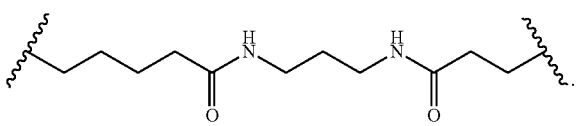 [SMILES: *CCCCC(=O)NCCCNC(=O)CC*]

Embodiment 559

The conjugated antisense compound of any of embodiments 493 to 502 or 511 to 558, wherein the cell-targeting moiety has the following structure:

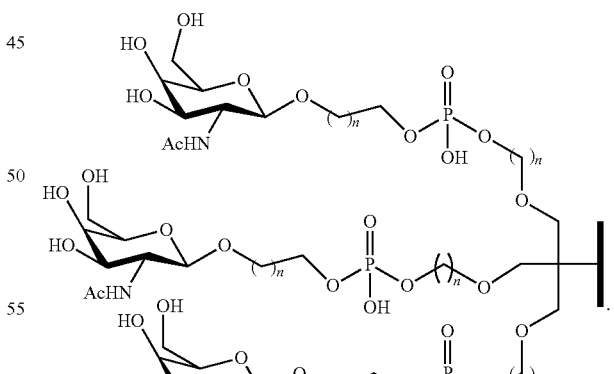

Embodiment 560

The conjugated antisense compound of any of embodiments 493 to 502 or 511 to 558, wherein the cell-targeting moiety has the following structure:

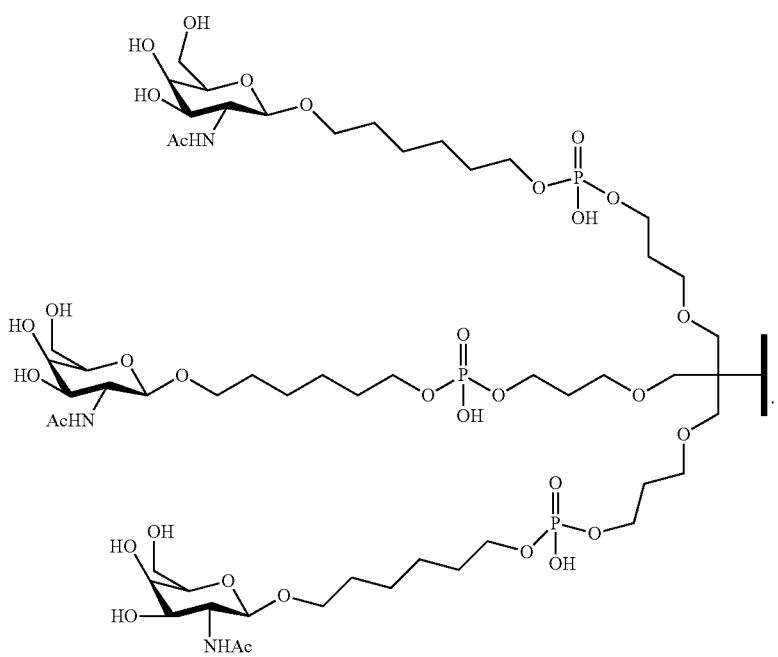

Embodiment 561

Embodiment 562

The conjugated antisense compound of any of embodiments 493 to 502 or 511 to 558, wherein the cell-targeting moiety comprises at least one ligand.

Embodiment 562

The conjugated antisense compound of embodiment 493 to 502 or 511 to 558, wherein the cell-targeting moiety comprises one ligand.

Embodiment 563

The conjugated antisense compound of embodiment 493 to 502 or 511 to 558, wherein the targeting moiety comprises two ligands.

Embodiment 564

The conjugated antisense compound of embodiment 493 to 502 or 511 to 558, wherein the targeting moiety comprises three ligands.

Embodiment 565

The conjugated antisense compound of any of embodiments 561 to 564, wherein each ligand is covalently attached to each tether.

Embodiment 566

The conjugated antisense compound of any of embodiments 561 to 564, wherein at least one ligand is N-Acetylgalactosamine (GalNAc).

Embodiment 567

The conjugated antisense compound of any of embodiments 561 to 564, wherein each ligand is N-Acetylgalactosamine (GalNAc).

Embodiment 568

Embodiment 568

The conjugated antisense compound of any of embodiments 561 to 564, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, β-D-Mannofuranose, α-D-Mannopyranose, β-D-Mannopyranose, α-D-Glucopyranose, β-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 569

The conjugated antisense compound of any of embodiments 561 to 564, wherein the ligand is galactose.

Embodiment 570

The conjugated antisense compound of any of embodiments 561 to 564, wherein the ligand is mannose-6-phosphate.

Embodiment 571

The conjugated antisense compound of any of embodiments 561 to 564, wherein each ligand is selected from among:

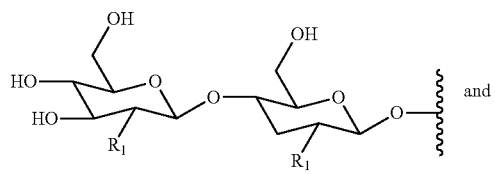

and

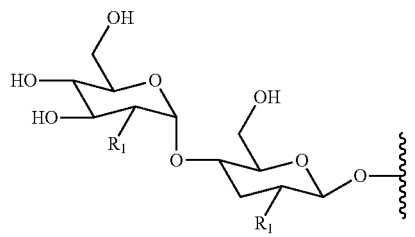

wherein each $R_1$ is selected from OH and NHCOOH.

Embodiment 572

The conjugated antisense compound of any of embodiments 561 to 564, wherein each ligand is selected from among:

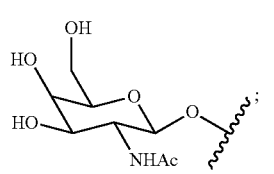

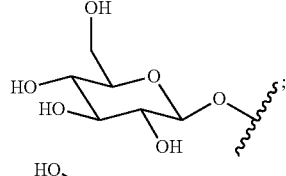

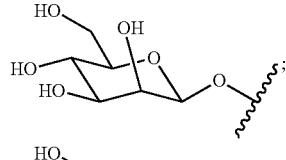

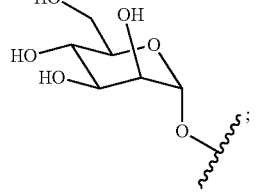

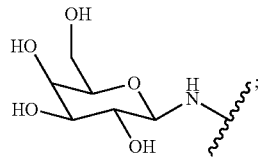

-continued

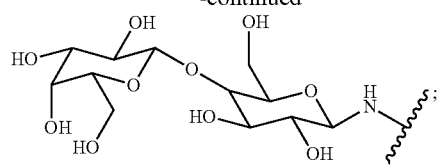

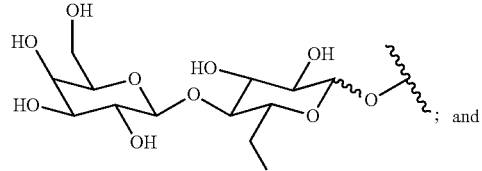

and

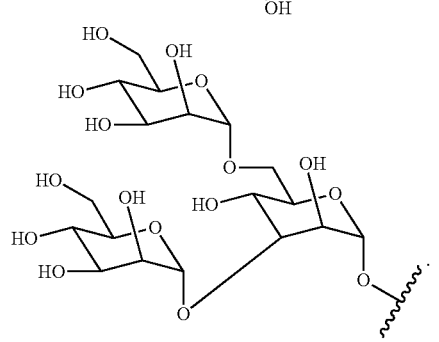

Embodiment 573

The conjugated antisense compound of any of embodiments 561 to 564, wherein each ligand has the following structure:

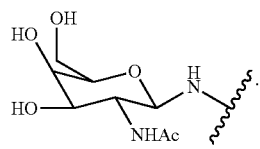 [SMILES: *NC1OC(CO)C(O)C(O)C1NC(C)=O]

Embodiment 574

The conjugated antisense compound of any of embodiments 561 to 564, wherein each ligand has the following structure:

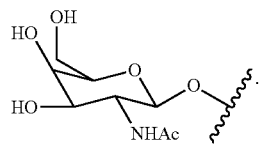 [SMILES: *OC1OC(CO)C(O)C(O)C1NC(C)=O]

Embodiment 575

The conjugated antisense compound of any of embodiments 493 to 502 or 511 to 574, wherein the cell-targeting moiety has the following structure:

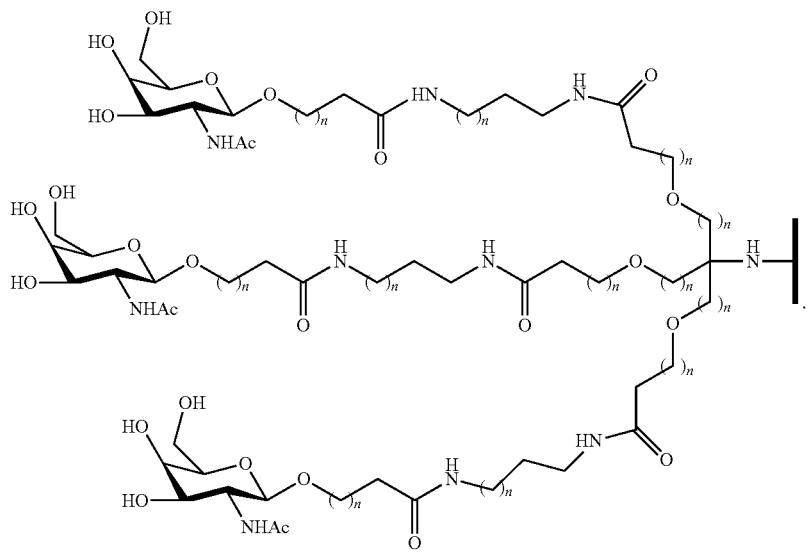
wherein each n is, independently, from 1 to 20.
Embodiment 576
The conjugated antisense compound of any of embodiments 493 to 502 or 511 to 574, wherein the cell-targeting moiety has the following structure:
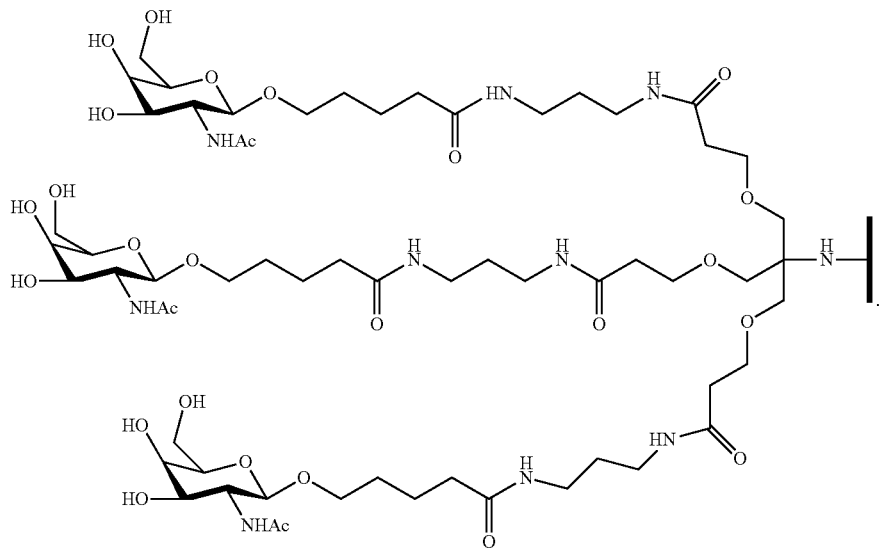
Embodiment 577
The conjugated antisense compound of any of embodiments 493 to 502 or 511 to 574, wherein the conjugate group has the following structure:

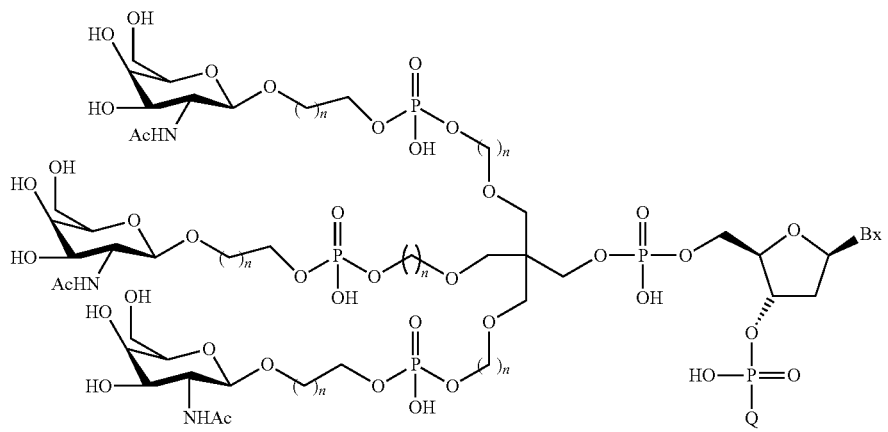

wherein each n is, independently, from 1 to 20;
Q is said antisense compound; and
Bx is a heterocyclic base moiety.

Embodiment 578

The conjugated antisense compound of any of embodiments 493 to 502 or 511 to 574, wherein the conjugate group has the following structure:

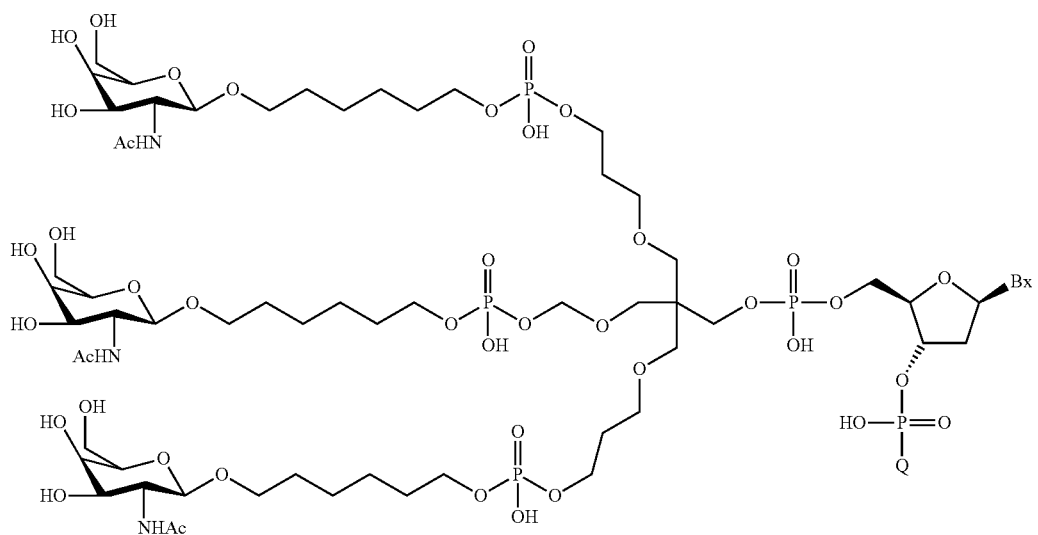

wherein each n is, independently, from 1 to 20;
Q is said antisense compound; and
Bx is a heterocyclic base moiety.

Embodiment 579

The conjugated antisense compound of any of embodiments 493 to 502 or 511 to 574, wherein the conjugate group has the following structure:

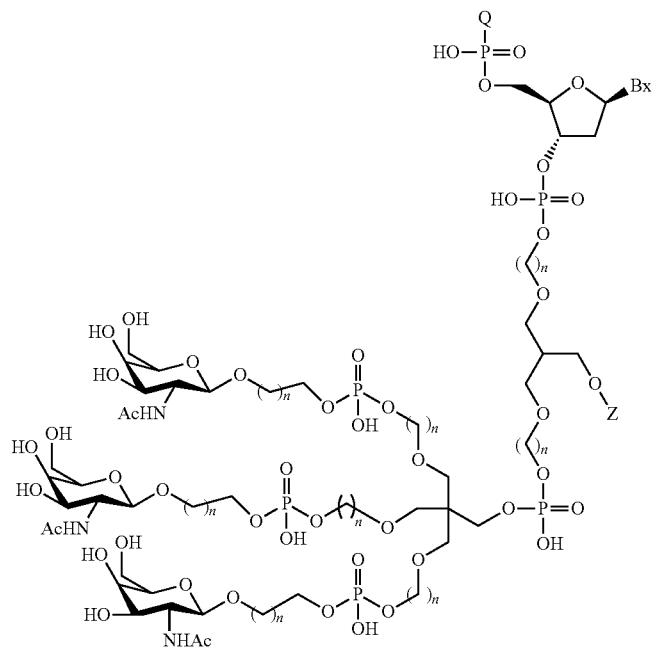
wherein each n is, independently, from 1 to 20;
Q is said antisense compound;
Z is H or a linked solid support; and
Bx is a heterocyclic base moiety.
Embodiment 580
The conjugated antisense compound of any of embodiments 493 to 502 or 511 to 574, wherein the conjugate group has the following structure:
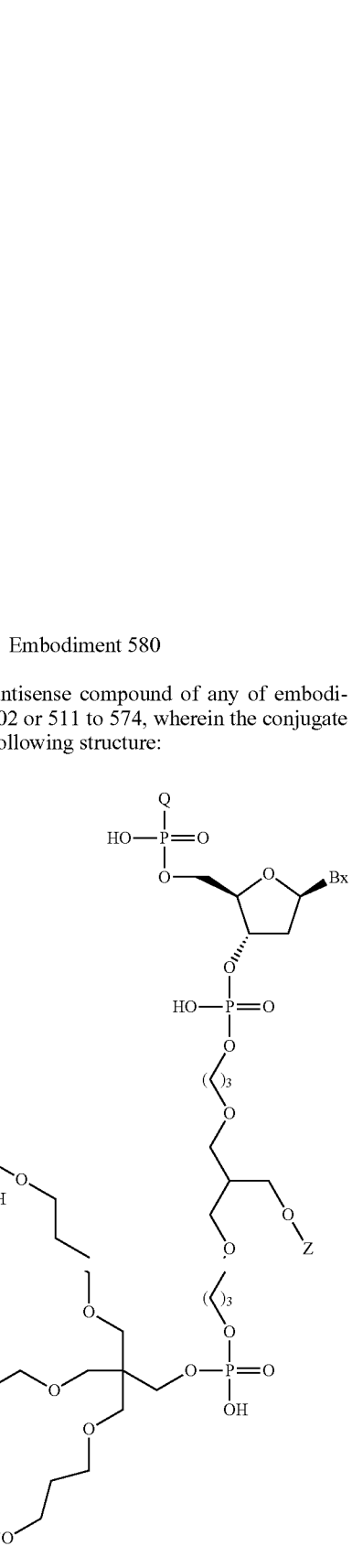

wherein each n is, independently, from 1 to 20;
Q is said antisense compound;
Z is H or a linked solid support; and
Bx is a heterocyclic base moiety.

Embodiment 581

The conjugated antisense compound of any of embodiments 493 to 502 or 511 to 574, wherein the conjugate group has the following structure:

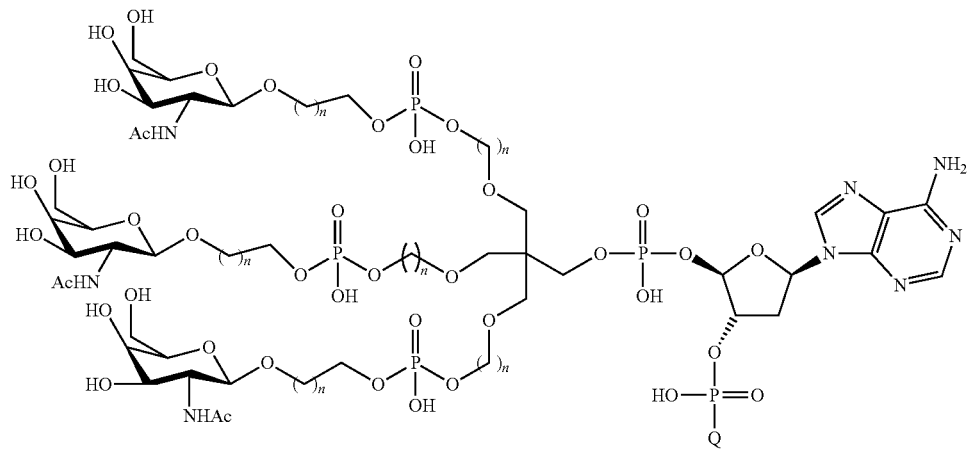

wherein Q is said antisense compound.

Embodiment 582

The conjugated antisense compound of any of embodiments 493 to 502 or 511 to 574, wherein the conjugate group has the following structure:

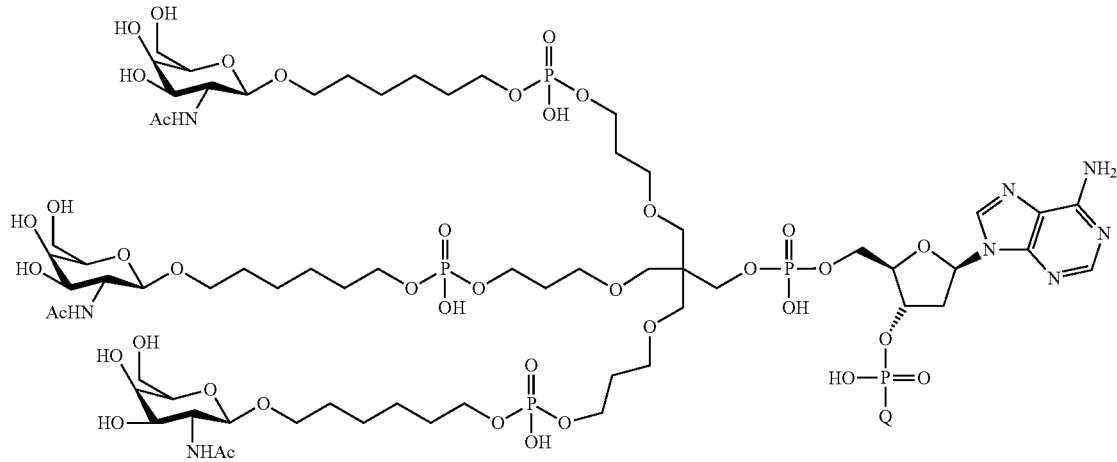

wherein Q is said antisense compound.

Embodiment 583

The conjugated antisense compound of any of embodiments 493 to 502 or 511 to 574, wherein the conjugate group has the following structure:

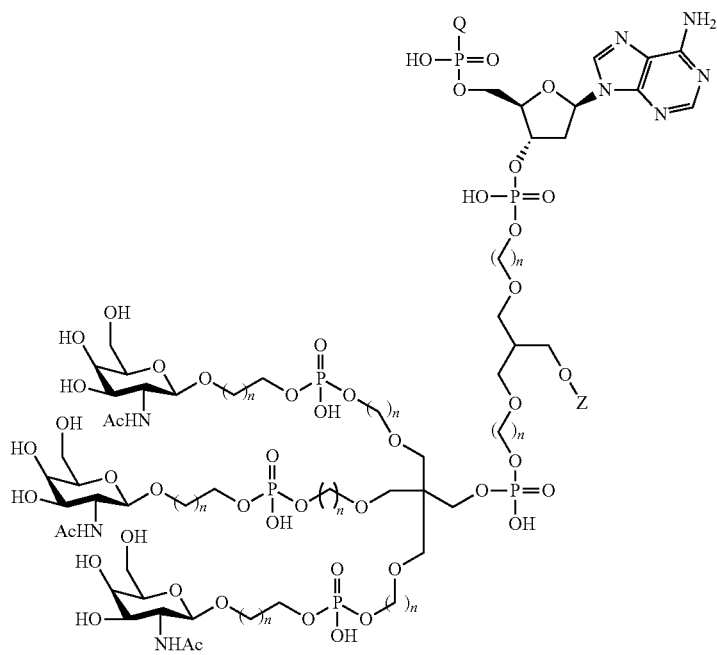
wherein Q is said antisense compound; and
Z is H or a linked solid support.
Embodiment 584
The conjugated antisense compound of any of embodiments 493 to 502 or 511 to 574, wherein the conjugate group has the following structure:
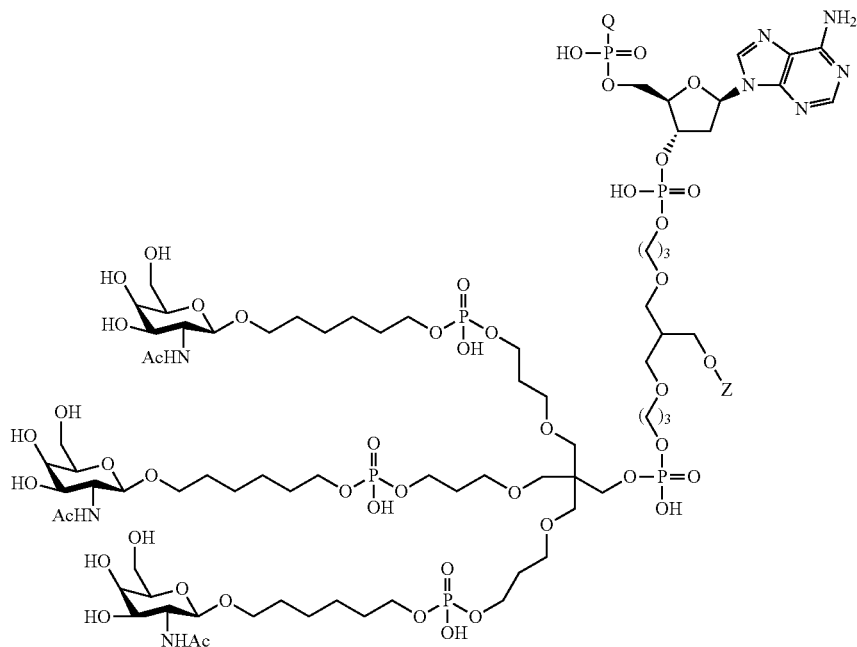
wherein Q is said antisense compound; and
Z is H or a linked solid support.

Embodiment 585

A conjugated oligonucleotide comprising an oligonucleotide and a conjugate group, wherein the conjugate group is any conjugate group of any of embodiments 493 to 584.

Embodiment 586

The conjugated oligonucleotide of embodiment 585 wherein the oligonucleotide comprises at least one modified nucleoside.

Embodiment 587

The conjugated oligonucleotide of embodiment 586 wherein the at least one modified nucleoside comprises a modified base.

Embodiment 588

The conjugated oligonucleotide of embodiment 586 or 587 wherein the at least one modified nucleoside comprises a sugar surrogate.

Embodiment 589

The conjugated oligonucleotide of embodiment 588 wherein the sugar surrogate is a tetrahydropyran.

Embodiment 590

The conjugated oligonucleotide of any of embodiment 589 wherein the tetrahydropyran is F-HNA.

Embodiment 591

The conjugated oligonucleotide of any of embodiments 586 to 590 wherein the remainder of the oligonucleotide comprises at least one nucleoside comprising a modified sugar.

Embodiment 592

The conjugated oligonucleotide of embodiment 591 wherein the at least one modified nucleoside comprising a modified sugar is selected from a bicyclic nucleoside and a 2'-modified nucleoside.

Embodiment 593

The conjugated oligonucleotide of embodiment 586 wherein the at least one modified nucleoside is a bicyclic nucleoside.

Embodiment 594

The conjugated oligonucleotide of embodiment 593 wherein the bicyclic nucleoside is a (4'-$CH_2$—O-2') BNA nucleoside.

Embodiment 595

The conjugated oligonucleotide of embodiment 593 wherein the bicyclic nucleoside is a (4'-$(CH_2)_2$—O-2') BNA nucleoside.

Embodiment 596

The conjugated oligonucleotide of embodiment 593 wherein the bicyclic nucleoside is a (4'-$C(CH_3)H$—O-2') BNA nucleoside.

Embodiment 597

The conjugated oligonucleotide of embodiment 586 wherein the at least one modified nucleoside is a 2'-modified nucleoside.

Embodiment 598

The conjugated oligonucleotide of embodiment 597 wherein the at least one 2'-modified nucleoside is selected from a 2'-F nucleoside, a 2'-$OCH_3$ nucleoside, and a 2'-$O(CH_2)_2OCH_3$ nucleoside.

Embodiment 599

The conjugated oligonucleotide of embodiment 598 wherein the at least one 2'-modified nucleoside is a 2'-F nucleoside.

Embodiment 600

The conjugated oligonucleotide of embodiment 598 wherein the at least one 2'-modified nucleoside is a 2'-$OCH_3$ nucleoside.

Embodiment 601

The conjugated oligonucleotide of embodiment 598 wherein the at least one 2'-modified nucleoside is a 2'-O$(CH_2)_2OCH_3$ nucleoside.

Embodiment 602

The conjugated oligonucleotide of any of embodiments 585-601 wherein the oligonucleotide comprises at least one unmodified nucleoside.

Embodiment 603

The conjugated oligonucleotide of embodiment 602 wherein the unmodified nucleoside is a ribonucleoside.

Embodiment 604

The conjugated oligonucleotide of embodiment 602 wherein the unmodified nucleoside is a deoxyribonucleoside.

Embodiment 605

The conjugated oligonucleotide of any of embodiments 585 to 604 wherein the oligonucleotide comprises at least two modified nucleosides.

Embodiment 606

The conjugated oligonucleotide of embodiment 605 wherein the at least two modified nucleosides comprise the same modification.

Embodiment 607

The conjugated oligonucleotide of embodiment 605 wherein the at least two modified nucleosides comprise different modifications.

Embodiment 608

The conjugated oligonucleotide of any of embodiments 605 to 607 wherein at least one of the at least two modified nucleosides comprises a sugar surrogate.

Embodiment 609

The conjugated oligonucleotide of any of embodiments 605 to 608 wherein at least one of the at least two modified nucleosides comprises a 2'-modification.

Embodiment 610

The conjugated oligonucleotide of embodiment 609 wherein each of the at least two modified nucleosides is independently selected from 2'-F nucleosides, 2'-OCH$_3$ nucleosides and 2'-O(CH$_2$)$_2$OCH$_3$ nucleosides.

Embodiment 611

The conjugated oligonucleotide of embodiment 610 wherein each of the at least two modified nucleosides is a 2'-F nucleoside.

Embodiment 612

The conjugated oligonucleotide of embodiment 610 wherein each of the at least two modified nucleosides is a 2'-OCH$_3$ nucleosides.

Embodiment 613

The conjugated oligonucleotide of embodiment 610 wherein each of the at least two modified nucleosides is a 2'-O(CH$_2$)$_2$OCH$_3$ nucleoside.

Embodiment 614

The conjugated oligonucleotide of any of embodiments 586 to 613 wherein essentially every nucleoside of the oligonucleotide is a modified nucleoside.

Embodiment 615

The conjugated oligonucleotide of any of embodiments 586 to 601 or 606 to 613 wherein every nucleoside of the oligonucleotide is a modified nucleoside.

Embodiment 616

The conjugated oligonucleotide of any of embodiments 586 to 615 wherein the oligonucleotide is single-stranded.

Embodiment 617

The conjugated oligonucleotide of any of embodiments 586 to 615 wherein the oligonucleotide is double-stranded.

Embodiment 618

The conjugated oligonucleotide of any of embodiments 586 to 615, wherein the oligonucleotide is an antisense compound.

Embodiment 619

The conjugated oligonucleotide of any of embodiments 586 to 615, wherein the oligonucleotide is a RISC based oligonucleotide.

Embodiment 620

The conjugated oligonucleotide of any of embodiments 586 to 615, wherein the oligonucleotide activates the RISC pathway.

Embodiment 621

The conjugated oligonucleotide of any of embodiments 586 to 615, wherein the oligonucleotide is an RNase H based antisense compound.

Embodiment 622

The conjugated oligonucleotide compound of any of embodiments 586 to 621, wherein the conjugate group is attached to the 5'-terminal nucleoside of the antisense oligonucleotide.

Embodiment 623

The conjugated oligonucleotide compound of any of embodiments 586 to 621, wherein the conjugate group is attached to the 3'-terminal nucleoside of the antisense oligonucleotide.

Embodiment 624

The conjugated oligonucleotide compound of any of embodiments 586 to 621, wherein the conjugate group is attached to an internal nucleoside of the antisense oligonucleotide.

Embodiment 625

The conjugated oligonucleotide compound of any of embodiments 586 to 624, wherein the conjugate group increases uptake of the conjugated oligonucleotide compound into a hepatocyte relative to an unconjugated oligonucleotide compound.

Embodiment 626

The conjugated oligonucleotide compound of any of embodiments 586 to 624, wherein the conjugate group increases the uptake of the conjugated oligonucleotide compound into a liver cell relative to an unconjugated oligonucleotide compound.

Embodiment 627

The conjugated oligonucleotide compound of any of embodiments 586 to 626, wherein the conjugate group increases accumulation of the conjugated oligonucleotide compound in the liver relative to an unconjugated oligonucleotide compound.

Embodiment 628

The conjugated oligonucleotide compound of any of embodiments 586 to 627, wherein the conjugate group decreases accumulation of the conjugated oligonucleotide compound in the kidneys relative to an unconjugated oligonucleotide compound.

Embodiment 629

The conjugated oligonucleotide compound of embodiment 586 to 628, wherein the conjugated oligonucleotide has a sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 630

The conjugated oligonucleotide compound of embodiment 629, wherein the 5'-region consists of 2 linked 5'-region nucleosides.

Embodiment 631

The conjugated oligonucleotide compound of embodiment 629, wherein the 5'-region consists of 3 linked 5'-region nucleosides.

Embodiment 632

The conjugated oligonucleotide compound of embodiment 629, wherein the 5'-region consists of 4 linked 5'-region nucleosides.

Embodiment 633

The conjugated oligonucleotide compound of embodiment 629, wherein the 5'-region consists of 5 linked 5'-region nucleosides.

Embodiment 634

The conjugated oligonucleotide compound of any of embodiments 629-633, wherein the 3'-region consists of 2 linked 3'-region nucleosides.

Embodiment 635

The conjugated oligonucleotide compound of any of embodiments 629-633, wherein the 3'-region consists of 3 linked 3'-region nucleosides.

Embodiment 636

The conjugated oligonucleotide compound of any of embodiments 629-633, wherein the 3'-region consists of 4 linked 3'-region nucleosides.

Embodiment 637

The conjugated oligonucleotide compound of any of embodiments 629-633, wherein the 3'-region consists of 5 linked 3'-region nucleosides.

Embodiment 638

The conjugated oligonucleotide compound of any of embodiments 629-633, wherein the central region consists of 5 linked central region nucleosides.

Embodiment 639

The conjugated oligonucleotide compound of any of embodiments 629-633, wherein the central region consists of 6 linked central region nucleosides.

Embodiment 640

The conjugated oligonucleotide compound of any of embodiments 629-633, wherein the central region consists of 7 linked central region nucleosides.

Embodiment 641

The conjugated oligonucleotide compound of any of embodiments 629-633, wherein the central region consists of 8 linked central region nucleosides.

Embodiment 642

The conjugated oligonucleotide compound of any of embodiments 629-633, wherein the central region consists of 9 linked central region nucleosides.

Embodiment 643

The conjugated oligonucleotide compound of any of embodiments 629-633, wherein the central region consists of 10 linked central region nucleosides.

Embodiment 644

The conjugated oligonucleotide compound of any of embodiments 629-644, wherein the conjugated oligonucleotide consists of 14 to 26 linked nucleosides.

Embodiment 645

The conjugated oligonucleotide compound of any of embodiments 629-644, wherein the conjugated oligonucleotide consists of 15 to 25 linked nucleosides.

Embodiment 646

The conjugated oligonucleotide compound of any of embodiments 629-644, wherein the conjugated oligonucleotide consists of 16 to 20 linked nucleosides.

Embodiment 647

The conjugated oligonucleotide compound of any of embodiments 629-644, wherein each modified nucleoside independently comprises a 2'-substituted sugar moiety or a bicyclic sugar moiety.

Embodiment 648

The conjugated oligonucleotide compound of embodiment 647, wherein the at least one modified nucleoside comprises a 2'-substituted sugar moiety.

Embodiment 649

The conjugated oligonucleotide compound of embodiment 648, wherein each modified nucleoside comprising a 2'-substituted sugar moiety comprises a 2' substituent independently selected from among: halogen, optionally substituted allyl, optionally substituted amino, azido, optionally substituted SH, CN, OCN, $CF_3$, $OCF_3$, O, S, or N(Rm)-alkyl; O, S, or N(Rm)-alkenyl; O, S or N(Rm)-alkynyl; optionally substituted O-alkylenyl-O-alkyl, optionally substituted alkynyl, optionally substituted alkaryl, optionally substituted aralkyl, optionally substituted O-alkaryl, optionally substituted O-aralkyl, $O(CH_2)_2SCH_3$, $O-(CH_2)_2-O-N(Rm)(Rn)$ or $O-CH_2-C(=O)-N(Rm)(Rn)$, where each Rm and Rn is, independently, H, an amino protecting group or substituted or unsubstituted $C_1$-$C_{10}$ alkyl; wherein each optionally substituted group is optionally substituted with a substituent group independently selected from among: hydroxyl, amino, alkoxy, carboxy, benzyl, phenyl, nitro ($NO_2$), thiol, thioalkoxy (S-alkyl), halogen, alkyl, aryl, alkenyl and alkynyl.

Embodiment 650

The conjugated oligonucleotide compound of embodiment 648, wherein each 2' substituent is independently selected from among: a halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2-CH=CH_2$, $O(CH_2)_2-OCH_3$, $O(CH_2)_2-SCH_3$, $O(CH_2)_2-OCF_3$, $O(CH_2)_3-N(R_1)(R_2)$, $O(CH_2)_2-ON(R_1)(R_2)$, $O(CH_2)_2-O(CH_2)_2-N(R_1)(R_2)$, $OCH_2C(=O)-N(R_1)(R_2)$, $OCH_2C(=O)-N(R_3)-(CH_2)_2-N(R_1)(R_2)$, and $O(CH_2)_2-N(R_3)-C(=NR_4)[N(R_1)(R_2)]$; wherein $R_1$, $R_2$, $R_3$ and $R_4$ are each, independently, H or $C_1$-$C_6$ alkyl.

Embodiment 651

The conjugated oligonucleotide compound of embodiment 648, wherein each 2' substituent is independently selected from among: a halogen, $OCH_3$, $OCF_3$, $OCH_2CH_3$, $OCH_2CF_3$, $OCH_2-CH=CH_2$, $O(CH_2)_2-OCH_3$ (MOE), $O(CH_2)_2-O(CH_2)_2-N(CH_3)_2$, $OCH_2C(=O)-N(H)CH_3$, $OCH_2C(=O)-N(H)-(CH_2)_2-N(CH_3)_2$, and $OCH_2-N(H)-C(=NH)NH_2$.

Embodiment 652

The conjugated oligonucleotide compound of embodiment 648, wherein the at least one 2'-modified nucleoside comprises a 2'-MOE sugar moiety.

Embodiment 653

The conjugated oligonucleotide compound of embodiment 648, wherein the at least one 2'-modified nucleoside comprises a 2'-OMe sugar moiety.

Embodiment 654

The conjugated oligonucleotide compound of embodiment 648, wherein the at least one 2'-modified nucleoside comprises a 2'-F sugar moiety.

Embodiment 655

The conjugated oligonucleotide compound of any of embodiments 629-644, wherein the conjugated oligonucleotide comprises at least one modified nucleoside comprising a sugar surrogate.

Embodiment 656

The conjugated oligonucleotide compound of embodiment 655, wherein the modified nucleoside comprises an F-HNA sugar moiety.

Embodiment 657

The conjugated oligonucleotide compound of embodiment 655, wherein the modified nucleoside comprises an HNA sugar moiety.

Embodiment 658

The conjugated oligonucleotide compound of any of embodiments 629-657 wherein the conjugated oligonucleotide comprises at least one modified nucleoside comprising a bicyclic sugar moiety.

Embodiment 659

The conjugated oligonucleotide compound of embodiment 658, wherein the bicyclic sugar moiety is a cEt sugar moiety.

Embodiment 660

The conjugated oligonucleotide compound of embodiment 658, wherein bicyclic sugar moiety is an LNA sugar moiety.

Embodiment 661

The conjugated oligonucleotide compound of any of embodiments 585 to 660, wherein the conjugated oligonucleotide comprises at least one modified internucleoside linkage.

Embodiment 662

The conjugated oligonucleotide compound of embodiment 661, wherein each internucleoside linkage of the conjugated oligonucleotide is a modified internucleoside linkage.

Embodiment 663

The conjugated oligonucleotide compound of embodiment 661, wherein the conjugated oligonucleotide comprises at least one modified linkage and at least one unmodified phosphodiester internucleoside linkage.

Embodiment 664

The conjugated oligonucleotide compound of any of embodiments 661 to 663 wherein at least one modified internucleoside linkage is a phosphosphorothioate internucleoside linkage.

Embodiment 665

The conjugated oligonucleotide compound of any of embodiments 661 to 663, wherein each modified internucleoside linkage is a phosphorothioate internucleoside linkage.

Embodiment 666

The conjugated oligonucleotide compound of any of embodiments 661 to 662, wherein the conjugated oligonucleotide comprises at least 2 phosphodiester internucleoside linkages.

Embodiment 667

The conjugated oligonucleotide compound of any of embodiments 661 to 662, wherein the conjugated oligonucleotide comprises at least 3 phosphodiester internucleoside linkages.

Embodiment 668

The conjugated oligonucleotide compound of any of embodiments 661 to 662, wherein the conjugated oligonucleotide comprises at least 4 phosphodiester internucleoside linkages.

Embodiment 669

The conjugated oligonucleotide compound of any of embodiments 661 to 662, wherein the conjugated oligonucleotide comprises at least 5 phosphodiester internucleoside linkages.

Embodiment 670

The conjugated oligonucleotide compound of any of embodiments 661 to 662, wherein the conjugated oligonucleotide comprises at least 6 phosphodiester internucleoside linkages.

Embodiment 671

The conjugated oligonucleotide compound of any of embodiments 661 to 662, wherein the conjugated oligonucleotide comprises at least 7 phosphodiester internucleoside linkages.

Embodiment 672

The conjugated oligonucleotide compound of any of embodiments 661 to 662, wherein the conjugated oligonucleotide comprises at least 8 phosphodiester internucleoside linkages.

Embodiment 673

The conjugated oligonucleotide compound of any of embodiments 661 to 662, wherein the conjugated oligonucleotide comprises at least 9 phosphodiester internucleoside linkages.

Embodiment 674

The conjugated oligonucleotide compound of any of embodiments 661 to 662, wherein the conjugated oligonucleotide comprises at least 10 phosphodiester internucleoside linkages.

Embodiment 675

The conjugated oligonucleotide compound of any of embodiments 661 or 663 to 674, wherein the conjugated oligonucleotide comprises fewer than 16 phosphorothioate internucleoside linkages.

Embodiment 676

The conjugated oligonucleotide compound of any of embodiments 661 or 663 to 674, wherein the conjugated oligonucleotide comprises fewer than 15 phosphorothioate internucleoside linkages.

Embodiment 677

The conjugated oligonucleotide compound of any of embodiments 661 or 663 to 674, wherein the conjugated oligonucleotide comprises fewer than 14 phosphorothioate internucleoside linkages.

Embodiment 678

The conjugated oligonucleotide compound of any of embodiments 661 or 663 to 674, wherein the conjugated oligonucleotide comprises fewer than 13 phosphorothioate internucleoside linkages.

Embodiment 679

The conjugated oligonucleotide compound of any of embodiments 661 or 663 to 674, wherein the conjugated oligonucleotide comprises fewer than 12 phosphorothioate internucleoside linkages.

Embodiment 680

The conjugated oligonucleotide compound of any of embodiments 661 or 663 to 674, wherein the conjugated

Embodiment 681

The conjugated oligonucleotide compound of any of embodiments 661 or 663 to 674, wherein the conjugated oligonucleotide comprises fewer than 10 phosphorothioate internucleoside linkages.

Embodiment 682

The conjugated oligonucleotide compound of any of embodiments 661 or 663 to 674, wherein the conjugated oligonucleotide comprises fewer than 9 phosphorothioate internucleoside linkages.

Embodiment 683

The conjugated oligonucleotide compound of any of embodiments 661 or 663 to 674, wherein the conjugated oligonucleotide comprises fewer than 8 phosphorothioate internucleoside linkages.

Embodiment 684

The conjugated oligonucleotide compound of any of embodiments 661 or 663 to 674, wherein the conjugated oligonucleotide comprises fewer than 7 phosphorothioate internucleoside linkages.

Embodiment 685

The conjugated oligonucleotide compound of any of embodiments 661 or 663 to 674, wherein the conjugated oligonucleotide comprises fewer than 6 phosphorothioate internucleoside linkages.

Embodiment 686

The conjugated oligonucleotide compound of any of embodiments 585 to 685, wherein each terminal internucleoside linkage of the conjugated oligonucleotide is a phosphorothioate internucleoside linkage.

Embodiment 687

The conjugated oligonucleotide compound of any of embodiments 585 to 662 or 665 to 686, wherein each internucleoside linkage linking two deoxynucleosides of the conjugated oligonucleotide is a phosphorothioate internucleoside linkage.

Embodiment 688

The conjugated oligonucleotide compound of any of embodiments 585 to 662 or 665 to 687, wherein each non-terminal internucleoside linkage linking two modified nucleosides of the conjugated oligonucleotide is a phosphodiester internucleoside linkage.

Embodiment 689

The conjugated oligonucleotide compound of any of embodiments 585 to 662 or 665 to 688, wherein each non-terminal internucleoside linkage of the conjugated oligonucleotide that is 3' of a modified nucleoside is a phosphodiester internucleoside linkage.

Embodiment 690

The conjugated oligonucleotide compound of any of embodiments 585 to 662 or 665 to 689, wherein each internucleoside linkage of the conjugated oligonucleotide that is 3' of a deoxynucleoside is a phosphorothioate internucleoside linkage.

Embodiment 691

The conjugated oligonucleotide compound of any of embodiments 585 to 662 or 665 to 690 wherein the conjugated oligonucleotide has a chemical motif selected from among:

$MsMy(Ds)_{0-1}(DsDs)_{(3-5)}MsM$
$MsMy(Ds)_{0-1}(DsDs)_{(3-5)}MyMsM$
$MsMy(Ds)_{0-1}(DsDs)_{(3-5)}MyMyMsM$
$MsMy(Ds)_{0-1}(DsDs)_{(3-5)}MyMyMyMsM$
$MsMyMy(Ds)_{0-1}(DsDs)_{(3-5)}MsM$
$MsMyMy(Ds)_{0-1}(DsDs)_{(3-5)}MyMsM$
$MsMyMy(Ds)_{0-1}(DsDs)_{(3-5)}MyMyMsM$
$MsMyMy(Ds)_{0-1}(DsDs)_{(3-5)}MyMyMyMsM$
$MsMyMyMy(Ds)_{0-1}(DsDs)_{(3-5)}MsM$
$MsMyMyMy(Ds)_{0-1}(DsDs)_{(3-5)}MyMsM$
$MsMyMyMy(Ds)_{0-1}(DsDs)_{(3-5)}MyMyMsM$
$MsMyMyMy(Ds)_{0-1}(DsDs)_{(3-5)}MyMyMyMsM$
$MsMyMyMyMy(Ds)_{0-1}(DsDs)_{(3-5)}MsM$
$MsMyMyMyMy(Ds)_{0-1}(DsDs)_{(3-5)}MyMsM$
$MsMyMyMyMy(Ds)_{0-1}(DsDs)_{(3-5)}MyMyMsM$; and
$MsMyMyMyMy(Ds)_{0-1}(DsDs)_{(3-5)}MyMyMyMsM$;

wherein each M is independently a modified nucleoside, each D is a deoxynucleoside; each s is a phosphorothioate internucleoside linkage, and each y is either a phosphodiester internucleoside linkage or a phosphorothioate internucleoside linkage, provided that at least one y is a phosphodiester internucleotide linkage.

Embodiment 692

The conjugated oligonucleotide compound of any of embodiments 585 to 662 or 665 to 690 wherein the conjugated oligonucleotides has a chemical motif selected from among:

$MsMo(Ds)_{0-1}(DsDs)_{(3-5)}MoMsM$
$MsMo(Ds)_{0-1}(DsDs)_{(3-5)}MoMoMsM$
$MsMo(Ds)_{0-1}(DsDs)_{(3-5)}MoMoMoMsM$
$MsMoMo(Ds)_{0-1}(DsDs)_{(3-5)}MsM$
$MsMoMo(Ds)_{0-1}(DsDs)_{(3-5)}MoMsM$
$MsMoMo(Ds)_{0-1}(DsDs)_{(3-5)}MoMoMsM$
$MsMoMo(Ds)_{0-1}(DsDs)_{(3-5)}MoMoMoMsM$
$MsMoMoMo(Ds)_{0-1}(DsDs)_{(3-5)}MsM$
$MsMoMoMo(Ds)_{0-1}(DsDs)_{(3-5)}MoMsM$
$MsMoMoMo(Ds)_{0-1}(DsDs)_{(3-5)}MoMoMsM$
$MsMoMoMo(Ds)_{0-1}(DsDs)_{(3-5)}MoMoMoMsM$
$MsMoMoMoMo(Ds)_{0-1}(DsDs)_{(3-5)}MsM$
$MsMoMoMoMo(Ds)_{0-1}(DsDs)_{(3-5)}MoMsM$
$MsMoMoMoMo(Ds)_{0-1}(DsDs)_{(3-5)}MoMoMsM$; and
$MsMoMoMoMo(Ds)_{0-1}(DsDs)_{(3-5)}MoMoMoMsM$;

wherein each M is independently a modified nucleoside, each D is a deoxynucleoside; each o is a phosphodiester internucleoside linkage, and each s is a phosphorothioate internucleoside linkage.

Embodiment 693

The conjugated oligonucleotide compound of embodiment 691 or 692, wherein each M is independently selected from among: a 2'-MOE nucleoside and a bicyclic nucleoside.

Embodiment 694

The conjugated oligonucleotide compound of embodiment 693, wherein each M is independently selected from among a 2'-MOE nucleoside, a cEt nucleoside, and an LNA nucleoside.

Embodiment 695

The conjugated oligonucleotide compound of embodiment 693 or 694, wherein each M is a 2'-MOE nucleoside.

Embodiment 696

The conjugated oligonucleotide compound of embodiment 693 or 694, wherein each M is a cEt nucleoside.

Embodiment 697

The conjugated oligonucleotide compound of embodiments 693 or 694, wherein each M is an LNA nucleoside.

Embodiment 698

The conjugated oligonucleotide compound of any of embodiments 585 to 697, wherein the conjugated oligonucleotide has a nucleobase sequence comprising an at least 8 nucleobase portion complementary to an equal length portion of a target nucleic acid.

Embodiment 699

The conjugated oligonucleotide compound of any of embodiments 585 to 697, wherein the conjugated oligonucleotide has a nucleobase sequence comprising an at least 10 nucleobase portion complementary to an equal length portion of a target nucleic acid.

Embodiment 700

The conjugated oligonucleotide compound of any of embodiments 585 to 697, wherein the conjugated oligonucleotide has a nucleobase sequence comprising an at least 12 nucleobase portion complementary to an equal length portion of a target nucleic acid.

Embodiment 701

The conjugated oligonucleotide compound of any of embodiments 585 to 697, wherein the conjugated oligonucleotide has a nucleobase sequence comprising an at least 14 nucleobase portion complementary to an equal length portion of a target nucleic acid.

Embodiment 702

The conjugated oligonucleotide compound of any of embodiments 585 to 697, wherein the conjugated oligonucleotide has a nucleobase sequence comprising an at least 16 nucleobase portion complementary to an equal length portion of a target nucleic acid.

Embodiment 703

The conjugated oligonucleotide compound of any of embodiments 585 to 697, wherein the conjugated oligonucleotide has a nucleobase sequence comprising an at least 18 nucleobase portion complementary to an equal length portion of a target nucleic acid.

Embodiment 704

The conjugated oligonucleotide compound of any of embodiments 585 to 697, wherein the conjugated oligonucleotide is at least 90% complementary to a target nucleic acid.

Embodiment 705

The conjugated oligonucleotide compound of any of embodiments 585 to 697, wherein the conjugated oligonucleotide is at least 95% complementary to a target nucleic acid.

Embodiment 706

The conjugated oligonucleotide compound of any of embodiments 585 to 697, wherein the conjugated oligonucleotide is 100% complementary to a target nucleic acid.

Embodiment 707

The conjugated oligonucleotide compound of any of embodiments 698 to 706, wherein the target nucleic acid is a pre-mRNA.

Embodiment 708

The conjugated oligonucleotide compound of any of embodiments 698 to 706, wherein the target nucleic acid is an mRNA.

Embodiment 709

The conjugated oligonucleotide compound of any of embodiments 698 to 706, wherein the target nucleic acid is a micro RNA.

Embodiment 710

The conjugated oligonucleotide compound of any of embodiments 698 to 709, wherein the target nucleic acid is expressed in the liver.

Embodiment 711

The conjugated oligonucleotide compound of any of embodiments 698 to 709, wherein the target nucleic acid is expressed in hepatocytes.

Embodiment 712

The conjugated oligonucleotide compound of any of embodiments 698 to 709, wherein the target nucleic encodes a protein selected from among: Androgen Receptor, Apolipoprotein (a), Apolipoprotein B, Apolipoprotein C-III, C-Reactive Protein, eIF-4E, Factor VII, Factor XI, Glucocorticoid Receptor, Glucagon Receptor, Protein Tyrosine Phosphatase 1B, STAT3, and Transthyretin.

Embodiment 713

The conjugated oligonucleotide compound of any of embodiments 698 to 709 wherein the target nucleic acid is a viral nucleic acid.

Embodiment 714

The conjugated oligonucleotide compound of embodiment 713, wherein the viral nucleic acid expressed in the liver.

Embodiment 715

The conjugated oligonucleotide compound of embodiment 714, wherein the target nucleic acid is a Hepatitis B viral nucleic acid.

Embodiment 716

The conjugated oligonucleotide compound of any of embodiments 585 to 708, wherein the conjugated oligonucleotide comprises the nucleobase sequence of any one of SEQ ID NOs.: 17, 18, 19, 20, 21, 22, 23, or 24.

Embodiment 717

The conjugated oligonucleotide compound of any of embodiments 585 to 708, wherein the conjugated oligonucleotide comprises the nucleobase sequence of any one of SEQ ID NO.: 25, 26, 27, 28, 29, or 30.

Embodiment 718

The conjugated oligonucleotide compound of any of embodiments 585 to 708, wherein the conjugated oligonucleotide comprises the nucleobase sequence of SEQ ID NO.: 31.

Embodiment 719

The conjugated oligonucleotide compound of any of embodiments 585 to 708, wherein the conjugated oligonucleotide comprises the nucleobase sequence of SEQ ID NO.: 32.

Embodiment 720

The conjugated oligonucleotide compound of any of embodiments 585 to 708, wherein the conjugated oligonucleotide comprises the nucleobase sequence of SEQ ID NO.: 33.

Embodiment 721

The conjugated oligonucleotide compound of any of embodiments 585 to 708, wherein the conjugated oligonucleotide comprises the nucleobase sequence of SEQ ID NO.: 34.

Embodiment 722

The conjugated oligonucleotide compound of any of embodiments 585 to 708, wherein the conjugated oligonucleotide comprises the nucleobase sequence of any of SEQ ID NOs.: 35, 36, 37, 38, 39, 40, 41, 42, or 43.

Embodiment 723

The conjugated oligonucleotide compound of any of embodiments 585 to 708, wherein the conjugated oligonucleotide comprises the nucleobase sequence of SEQ ID NO.: 44, 45, 46, 47, or 48.

Embodiment 724

The conjugated oligonucleotide compound of any of embodiments 585 to 708, wherein the conjugated oligonucleotide comprises the nucleobase sequence of any of SEQ ID NOs.: 49, 50, 51, 52, 53, 54, 55, 56, 57, 58, or 59.

Embodiment 725

The conjugated oligonucleotide compound of any of embodiments 585 to 708, wherein the conjugated oligonucleotide comprises the nucleobase sequence of any of SEQ ID NOs.: 60, 61, 62, 63, 64, 65, 66, or 67.

Embodiment 726

The conjugated oligonucleotide compound of any of embodiments 585 to 708, wherein the conjugated oligonucleotide comprises the nucleobase sequence of any of SEQ ID NO.: 69, 70, 71, or 72.

Embodiment 727

The conjugated oligonucleotide compound of any of embodiments 585 to 708, wherein the conjugated oligonucleotide comprises the nucleobase sequence of SEQ ID NO.: 73.

Embodiment 728

The conjugated oligonucleotide compound of any of embodiments 585 to 708, wherein the conjugated oligonucleotide comprises the nucleobase sequence of any of SEQ ID NOs.: 74, 75, 76, 77, 78, 79, 80, or 81.

Embodiment 729

The conjugated oligonucleotide compound of any of embodiments 585 to 708, wherein the conjugated oligonucleotide comprises the nucleobase sequence of SEQ ID NO.: 68.

Embodiment 730

The conjugated oligonucleotide compound of any of embodiments 585 to 708, wherein the conjugated oligonucleotide comprises the nucleobase sequence of any of SEQ ID NOs.: 82-103.

Embodiment 731

The conjugated oligonucleotide compound of any of embodiments 585 to 731, wherein the conjugated oligonucleotide is an antisense oligonucleotide.

Embodiment 732

A method of reducing the amount or activity of a target nucleic acid in a cell, comprising contacting a cell with a compound or conjugated antisense compound of any of embodiments 493 to 731.

Embodiment 733

The method of embodiment 732, wherein the cell is a liver cell.

Embodiment 734

The method of embodiment 732, wherein the cell is a hepatocyte.

Embodiment 735

The method of any of embodiments 732 to 734 wherein the cell is in vitro.

Embodiment 736

The method of any of embodiments 732 to 734 wherein the cell is in an animal.

Embodiment 737

The method of embodiment 736 wherein the animal is a mouse.

Embodiment 738

The method of embodiment 736 wherein the animal is a human.

Embodiment 739

A pharmaceutical composition comprising a compound or conjugated oligonucleotide according to any of embodiments 493 to 731 and a pharmaceutically acceptable carrier or diluent.

Embodiment 740

The pharmaceutical composition of embodiment 739 wherein the pharmaceutically acceptable carrier or diluent is selected from among sterile water and sterile saline.

Embodiment 741

A method of treating a disease or condition in an animal comprising administering the pharmaceutical composition of embodiment 739 or 740 to the animal and thereby treating the disease or condition in the animal.

Embodiment 742

The method of embodiment 741 wherein the animal is a mouse.

Embodiment 743

The method of embodiment 741 wherein the animal is a human.

Embodiment 744

The method of any of embodiments 741 to 743, wherein the disease or condition is a liver disease or condition.

Embodiment 745

The method of any of embodiments 741 to 743 wherein the administration is parenteral.

Embodiment 746

The method embodiment 745 wherein the administration is by subcutaneous injection.

Embodiment 747

The method of embodiment 745 wherein the administration is by intravenous injection.

Embodiment 748

The method of embodiment 745 wherein the administration is by intramuscular injection.

Embodiment 749

The method of any of embodiments 741 to 748 wherein the conjugated oligonucleotide is provided at a dose of 1-10 mg/kg.

Embodiment 750

The method of any of embodiments 741 to 748 wherein the conjugated oligonucleotide is provided at a dose of less than 1 mg/kg.

Embodiment 751

The method of any of embodiments 741 to 748 wherein the conjugated oligonucleotide is provided at a dose of greater than 10 mg/kg.

Embodiment 752

The method of any of embodiments 741 to 751 wherein the conjugated oligonucleotide is provided for a dosing period of at least 2 months.

Embodiment 753

The method of any of embodiments 741 to 751 wherein the conjugated oligonucleotide is provided for a dosing period of at least 4 months.

Embodiment 754

The method of any of embodiments 741 to 751 wherein the conjugated oligonucleotide is provided for a dosing period of at least 6 months.

Embodiment 755

The method of any of embodiments 741 to 751 wherein the conjugated oligonucleotide is provided at a dosing frequency of about one dose every week.

Embodiment 756

The method of any of embodiments 741 to 751 wherein the conjugated oligonucleotide is provided at a dosing frequency of about one dose every two weeks.

Embodiment 757

The method of any of embodiments 741 to 751 wherein the conjugated oligonucleotide is provided at a dosing frequency of about one dose every three weeks.

Embodiment 758

The method of any of embodiments 741 to 751 wherein the conjugated oligonucleotide is provided at a dosing frequency of one dose every four weeks.

Embodiment 759

The method of any of embodiments 741 to 751 wherein the conjugated oligonucleotide is provided at a dosing frequency of one dose every five weeks.

Embodiment 760

The method of any of embodiments 741 to 751 wherein the conjugated oligonucleotide is provided at a dosing frequency of one dose every six weeks.

Embodiment 761

The method of any of embodiments 741 to 751 wherein the conjugated oligonucleotide is provided at a dosing frequency of one dose every seven weeks.

Embodiment 762

The method of any of embodiments 741 to 751 wherein the conjugated oligonucleotide is provided at a dosing frequency of one dose every eight weeks.

Embodiment 763

A conjugated antisense compound comprising: an antisense oligonucleotide comprising 12-30 linked nucleosides, and a conjugate group, wherein the conjugate group comprises at least one cell-targeting moiety.

Embodiment 764

A method of reducing the activity or amount of an Apolipoprotein C-III protein in a cell, comprising contacting a cell with at least one conjugated antisense compound of any of embodiments 493 to 731; and thereby reducing the activity or amount of the Apolipoprotein C-III protein in the cell.

Embodiment 765

A method of decreasing total cholesterol, comprising contacting a cell with at least one compound of any of embodiments 493 to 731; and thereby decreasing total cholesterol.

Embodiment 766

A method of decreasing triglycerides, comprising contacting a cell with at least one compound of any of embodiments 493 to 731; and thereby decreasing triglycerides.

Embodiment 767

A method of lowering LDL, comprising contacting a cell with at least one compound of any of embodiments 493 to 731; and thereby lowering LDL.

Embodiment 768

A method of increasing HDL, comprising contacting a cell with at least one compound of any of embodiments 493 to 731; and thereby increasing HDL.

Embodiment 769

The method of any of embodiments 764 to 768, wherein the cell is in vitro.

Embodiment 770

The method of any of embodiments 764 to 768, wherein the cell is in an animal.

Embodiment 771

The method of any of embodiments 764 to 768, wherein the animal is a human.

Embodiment 772

The compound or conjugated oligonucleotide of any of embodiments 1-771 or a prodrug thereof.

Embodiment 773

A prodrug of an antisense compound comprising the structure:

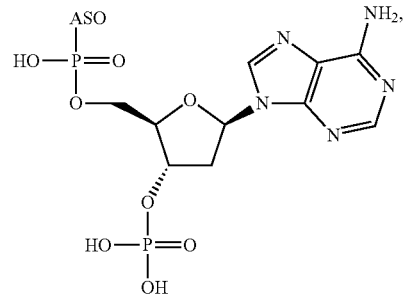

wherein ASO represents an antisense oligonucleotide of any of embodiments 1-771.

Embodiment 774

A prodrug of an antisense compound comprising the structure, wherein the one or more metabolites of the prodrug has the structure:

and wherein ASO represents an antisense oligonucleotide of any of embodiments 1-771.

Embodiment 775

A prodrug of an antisense compound, wherein one or more metabolites of the prodrug comprises an antisense oligonucleotide of any of embodiments 1-771.

Embodiment 776

A prodrug comprising:

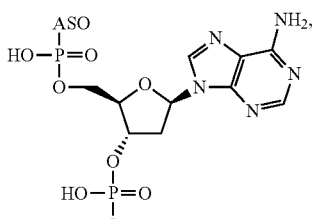
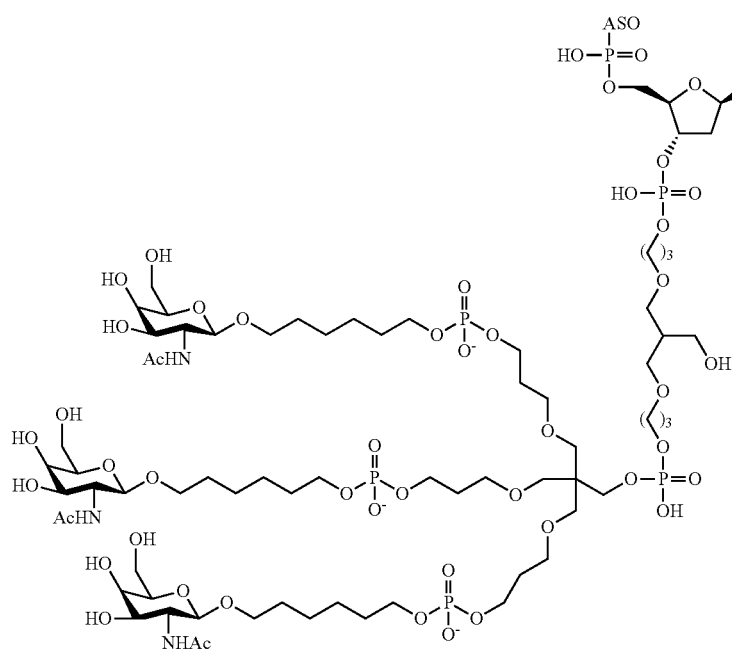

wherein ASO represents an antisense oligonucleotide of any of claims 1 to 731.

Embodiment 777

A method of manufacturing an antisense oligonucleotide of any of embodiments 1-771.

Embodiment 778

A method of preparing an antisense oligonucleotide of any of embodiments 1-771.

Embodiment 779

A conjugate compound comprising at least one phosphorus linking group or neutral linking group and one or more ligands.

Embodiment 780

The conjugate compound of embodiment 779 comprising two or more ligands.

Embodiment 781

The conjugate compound of embodiment 779 comprising three ligands.

Embodiment 782

The conjugate compound of any of embodiments 779 to 781, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, 13-D-Mannofuranose, α-D-Mannopyranose, β-D-Mannopyranose, α-D-Glucopyranose, β-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 783

The conjugate compound of any of embodiments 779 to 781, wherein the ligand is N-acetyl galactoseamine

Embodiment 784

The conjugate compound of any of embodiments 779 to 783, wherein conjugate group comprises a structure selected from among:

Embodiment 785

The conjugate compound of any of embodiments 779 to 784, wherein the conjugate compound has a tether having a structure selected from among:

wherein L is either a phosphorus linking group or a neutral linking group;

$Z_1$ is $C(=O)O-R_2$;

$Z_2$ is H, $C_1$-$C_6$ alkyl or substituted $C_1$-$C_6$ alky;

$R_2$ is H, $C_1$-$C_6$ alkyl or substituted $C_1$-$C_6$ alky; and each $m_1$ is, independently, from 0 to 20 wherein at least one $m_1$ is greater than 0 for each tether.

Embodiment 786

The conjugate compound of embodiment 785, wherein the tether has a structure selected from among:

wherein $Z_2$ is H or $CH_3$; and each $m_1$ is, independently, from 0 to 20 wherein at least one $m_1$ is greater than 0 for each tether.

Embodiment 787

The conjugate compound of any of embodiments 779 to 786, wherein the conjugate compound is covalently attached to an oligonucleotide.

Embodiment 788

An oligomeric compound comprising an oligonucleotide and at least one conjugate group, wherein at least one conjugate group is a conjugate compound of any of embodiments 780 to 786.

Embodiment 789

A compound having the formula (V):

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, or GalNAc$_3$-11a;

and the other of $T_3$ or $T_4$ is selected from among: a hydroxyl, a hydroxyl protecting group, a nucleoside, an oligonucleotide, a monomeric subunit, or an oligomeric compound; and wherein Bx is a heterocyclic base moiety.

Embodiment 790
A compound having the formula (VIII):
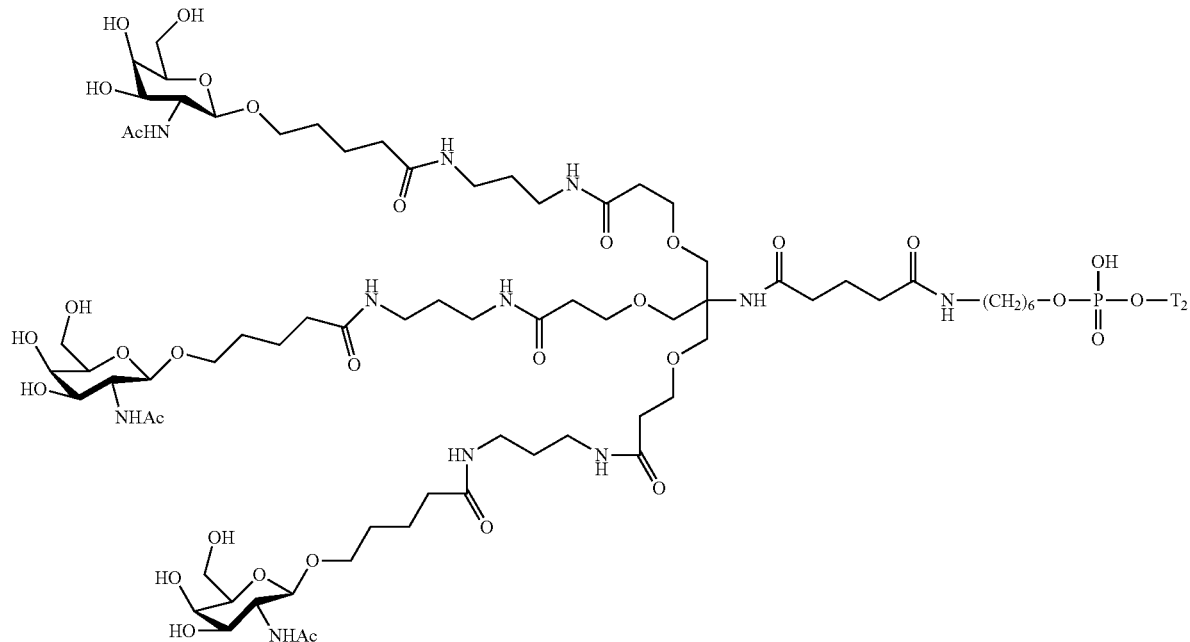
wherein:
T₂ is a nucleoside, a nucleotide, a monomeric subunit, or an oligomeric compound.
Embodiment 791
A compound having the formula (IX):
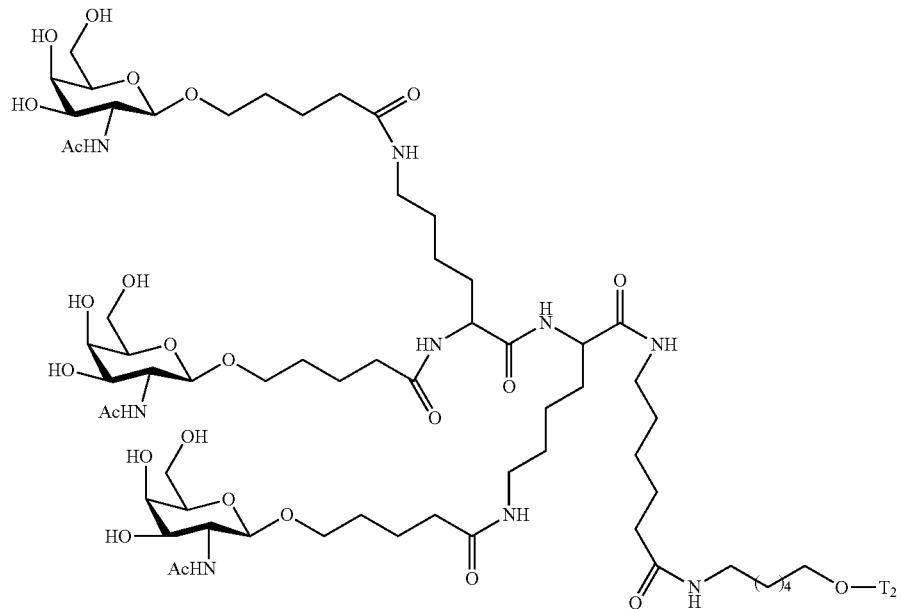
wherein:
T₂ is a nucleoside, a nucleotide, a monomeric subunit, or an oligomeric compound.

Embodiment 792
A compound having the formula (X):
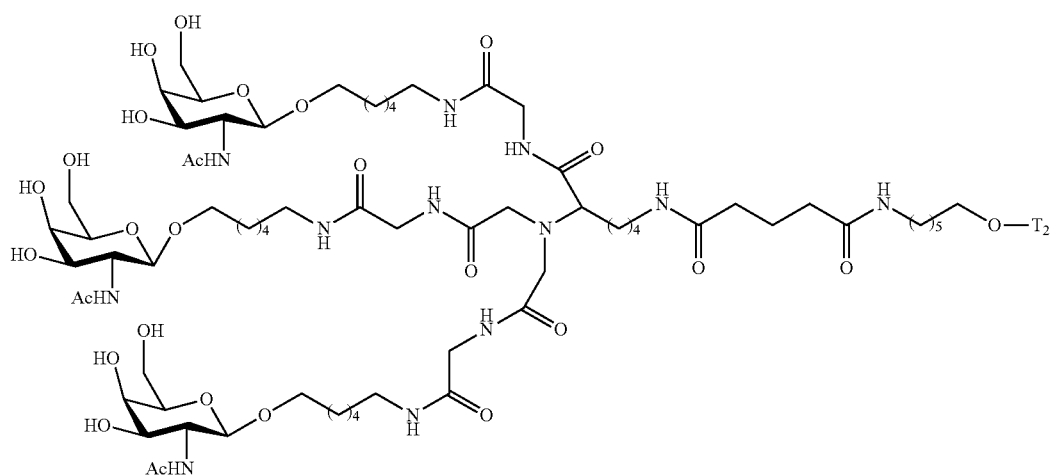
wherein:
$T_2$ is a nucleoside, a nucleotide, a monomeric subunit, or an oligomeric compound.
Embodiment 793
A compound having the formula (XI):
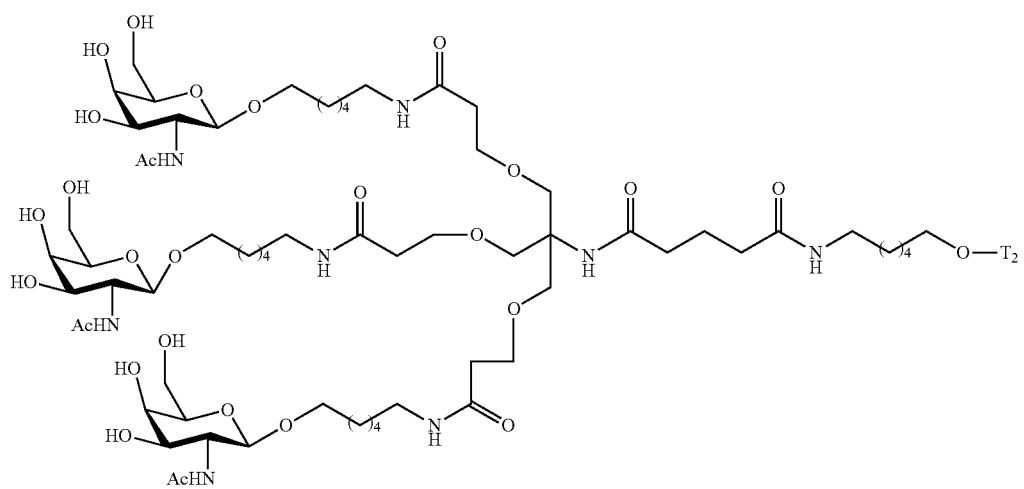
wherein:
$T_2$ is a nucleoside, a nucleotide, a monomeric subunit, or an oligomeric compound.

Embodiment 794
A compound having the formula (XII):
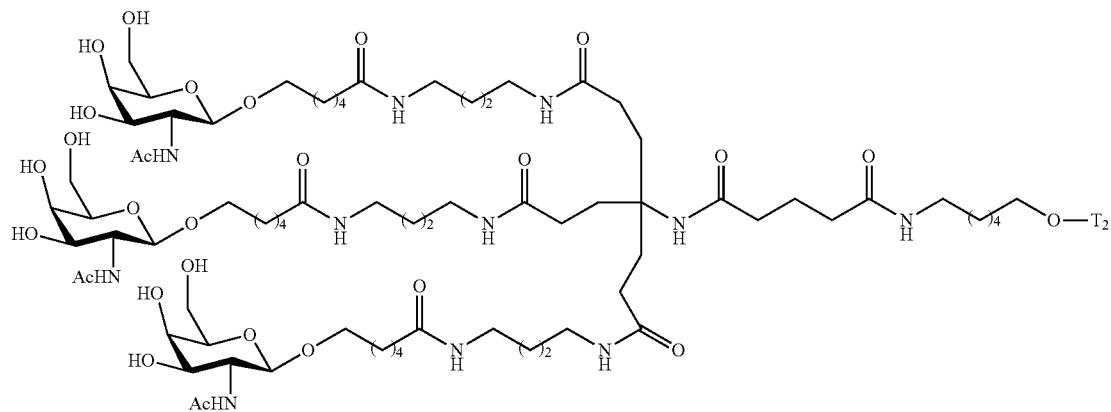
wherein:
$T_2$ is a nucleoside, a nucleotide, a monomeric subunit, or an oligomeric compound.
Embodiment 795
A compound having the formula (XIII):
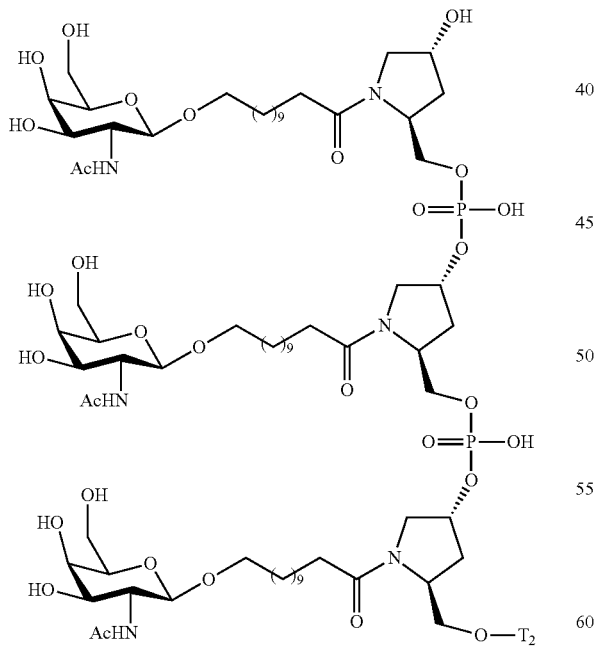
wherein:
$T_2$ is a nucleoside, a nucleotide, a monomeric subunit, or an oligomeric compound.

Embodiment 796
A compound having the formula (XIV):
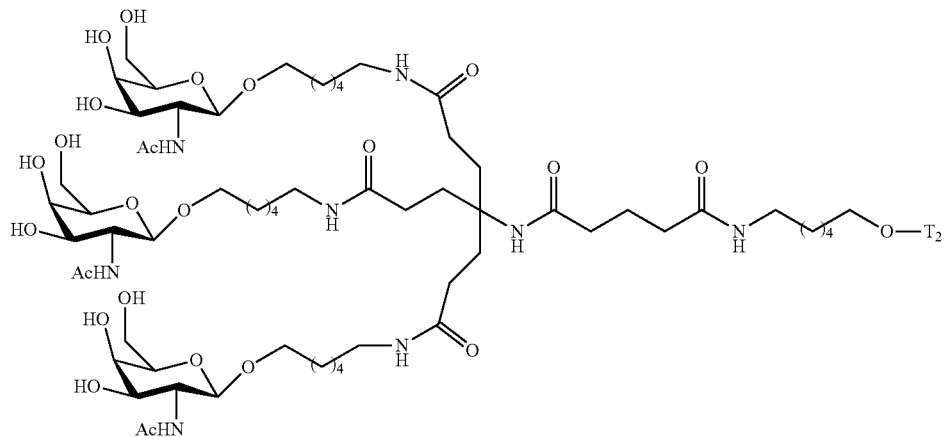
wherein:
$T_2$ is a nucleoside, a nucleotide, a monomeric subunit, or an oligomeric compound.
Embodiment 797
A compound having the formula (XV):
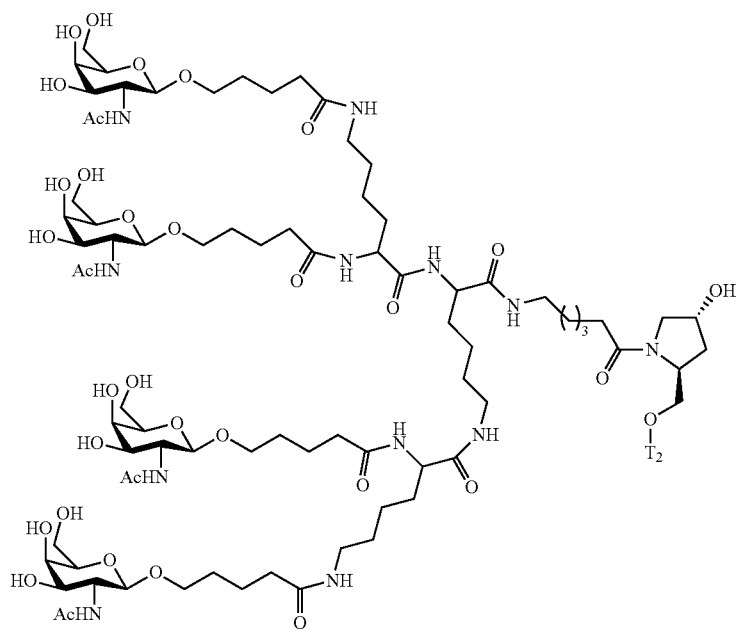
wherein:
$T_2$ is a nucleoside, a nucleotide, a monomeric subunit, or an oligomeric compound.

Embodiment 798

A compound having the formula (I):

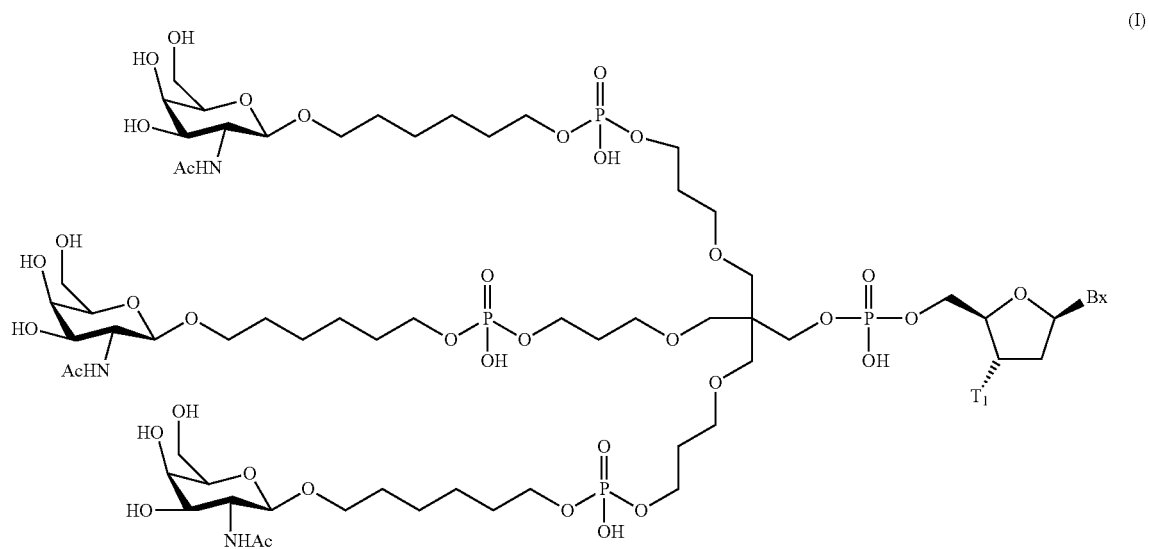

wherein:
Bx is a heterocyclic base moiety; and
$T_1$ is a hydroxyl, hydrogen, a hydroxyl protecting group, phosphorus moiety, or a reactive phosphorus group.

Embodiment 799

A compound having the formula (II):

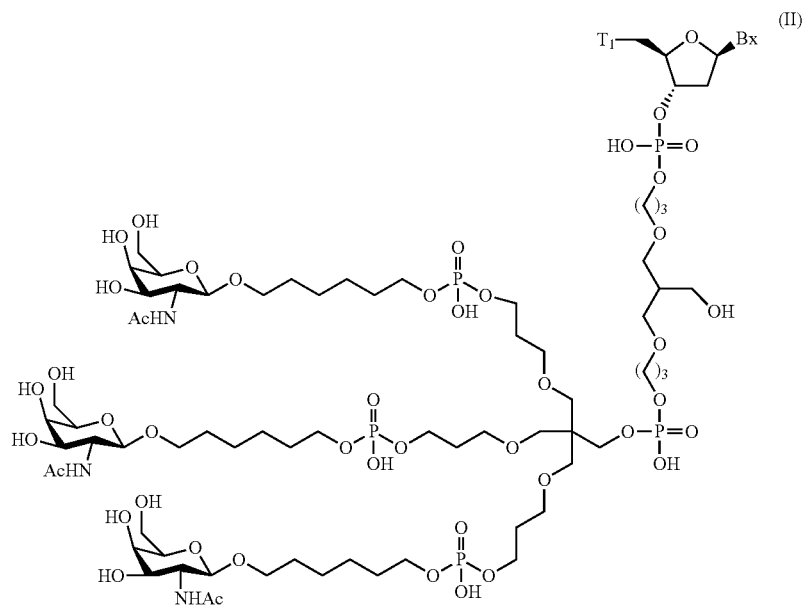

wherein:
Bx is a heterocyclic base moiety; and
$T_1$ is a hydroxyl, hydrogen, a hydroxyl protecting group, phosphorus moiety, or a reactive phosphorus group.

Embodiment 800

The compound of any of embodiment 798 or 799, wherein the phosphorus moiety has the formula:

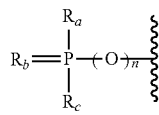

wherein:

n is 0 or 1;

$R_a$ and $R_c$ are each, independently, OH, SH, $C_1$-$C_6$ alkyl, substituted $C_1$-$C_6$ alkyl, $C_1$-$C_6$ alkoxy, substituted $C_1$-$C_6$ alkoxy, amino or substituted amino; and $R_b$ is O or S.

Embodiment 801

An oligomeric compound comprising an oligonucleotide and at least one conjugate group, wherein the at least one conjugate group is a conjugate compound of formula (III):

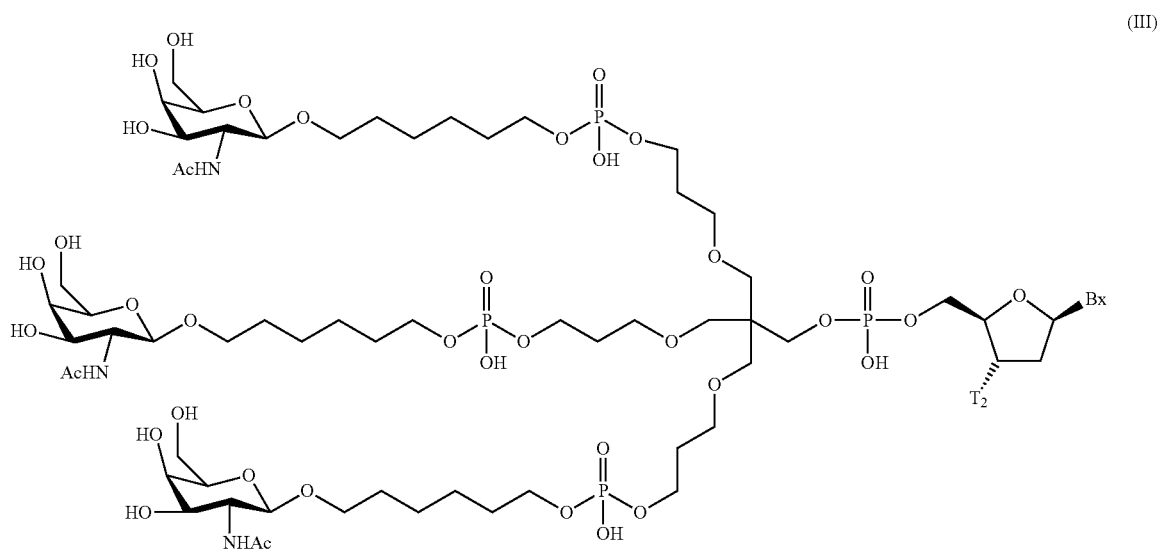

(III)

Wherein;

Bx is a heterocyclic base moiety; and $T_2$ is an internucleoside linking group attached to a nucleoside, a nucleotide, an oligonucleoside, an oligonucleotide, a monomeric subunit or an oligomeric compound.

Embodiment 802

An oligomeric compound comprising an oligonucleotide and at least one conjugate group, wherein the at least one conjugate group is a conjugate compound of formula (IV):

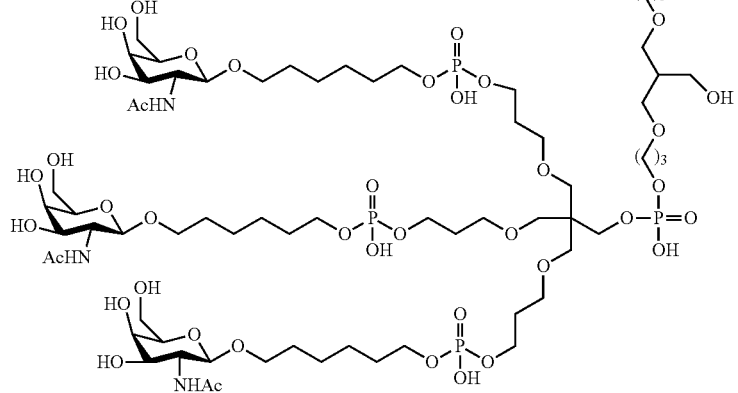
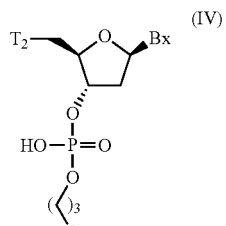

wherein:
Bx is a heterocyclic base moiety; and
$T_2$ is an internucleoside linking group attached to a nucleoside, a nucleotide, an oligonucleoside, an oligonucleotide, a monomeric subunit or an oligomeric compound.

Embodiment 803

The compound or oligomeric compound of any of embodiments 798 to 802, wherein the heterocyclic base moiety is a pyrimidine, substituted pyrimidine, purine or substituted purine.

Embodiment 804

The compound or oligomeric compound of any of embodiments 798 to 802, wherein Bx is uracil, thymine, cytosine, 5-methyl cytosine, adenine, or guanine.

Embodiment 805

The compound or oligomeric compound of any of embodiments 798 to 802, wherein Bx is adenine.

Embodiment 806

A conjugated antisense compound, wherein the compound has a structure represented by the formula:

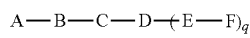

Wherein:
A is the antisense oligonucleotide;
B is the cleavable moiety
C is the conjugate linker
D is the branching group
each E is a tether;
each F is a ligand; and
q is an integer between 1 and 5.

Embodiment 807

A conjugated antisense compound, wherein the compound has a structure represented by the formula:

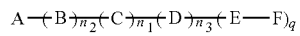

Wherein:
A is the antisense oligonucleotide;
B is the cleavable moiety
C is the conjugate linker
D is the branching group
each E is a tether;
each F is a ligand;
$n_1$ is 0 or 1; and
q is an integer between 1 and 5.

Embodiment 808

A conjugated antisense compound, wherein the compound has a structure represented by the formula:

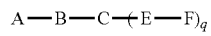

wherein
A is the antisense oligonucleotide;
B is the cleavable moiety;
C is the conjugate linker;
each E is a tether;
each F is a ligand; and
q is an integer between 1 and 5.

Embodiment 809

A conjugated antisense compound, wherein the compound has a structure represented by the formula:

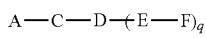
A—C—D—(E—F)$_q$ wherein
A is the antisense oligonucleotide;
C is the conjugate linker;
D is the branching group;
each E is a tether;
each F is a ligand; and
q is an integer between 1 and 5.

Embodiment 810

A conjugated antisense compound, wherein the compound has a structure represented by the formula:

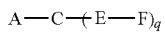
A—C—(E—F)$_q$ wherein
A is the antisense oligonucleotide;
C is the conjugate linker;
each E is a tether;
each F is a ligand; and
q is an integer between 1 and 5.

Embodiment 811

A conjugated antisense compound, wherein the compound has a structure represented by the formula:

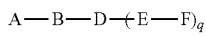
A—B—D—(E—F)$_q$ wherein
A is the antisense oligonucleotide;
B is the cleavable moiety;
D is the branching group;
each E is a tether;
each F is a ligand; and
q is an integer between 1 and 5.

Embodiment 812

A conjugated antisense compound, wherein the compound has a structure represented by the formula:

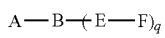
A—B—(E—F)$_q$ wherein
A is the antisense oligonucleotide;
B is the cleavable moiety;
each E is a tether;
each F is a ligand; and
q is an integer between 1 and 5.

Embodiment 813

A conjugated antisense compound, wherein the compound has a structure represented by the formula:

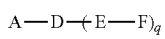
A—D—(E—F)$_q$ wherein
A is the antisense oligonucleotide;
D is the branching group;
each E is a tether;
each F is a ligand; and
q is an integer between 1 and 5.

Embodiment 814

The conjugated antisense compound of any of embodiments 806 to 810, wherein the conjugate linker has a structure selected from among:

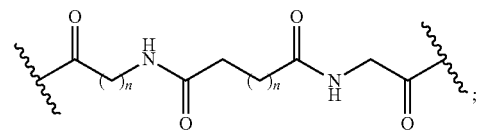

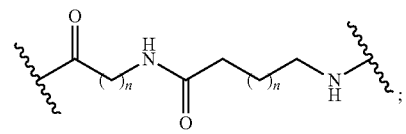

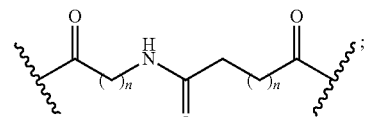

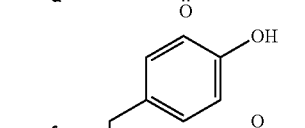

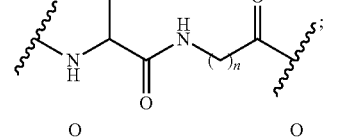

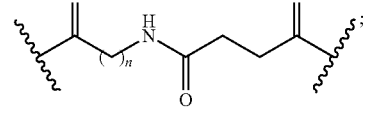

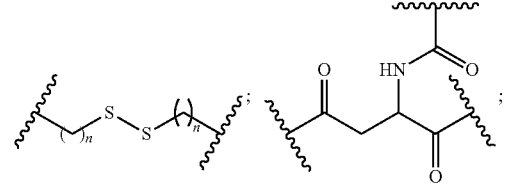

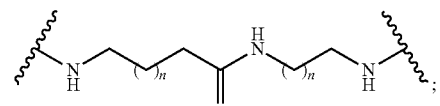

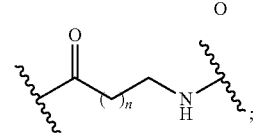

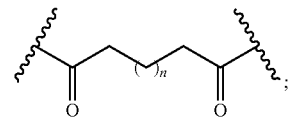

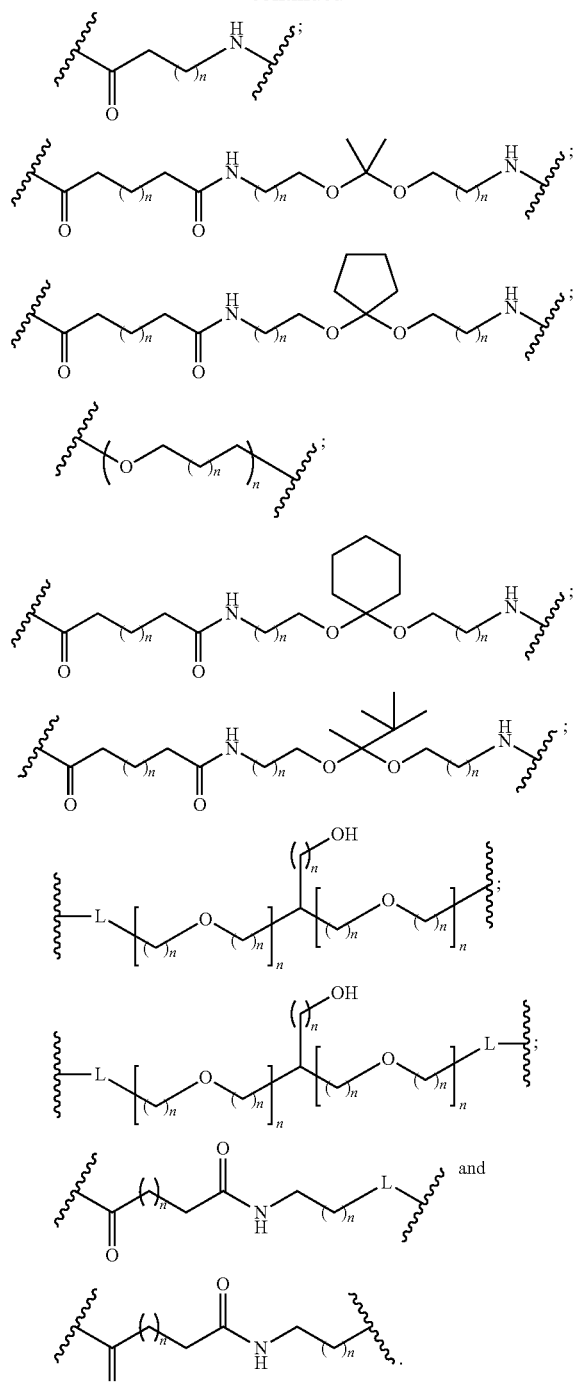
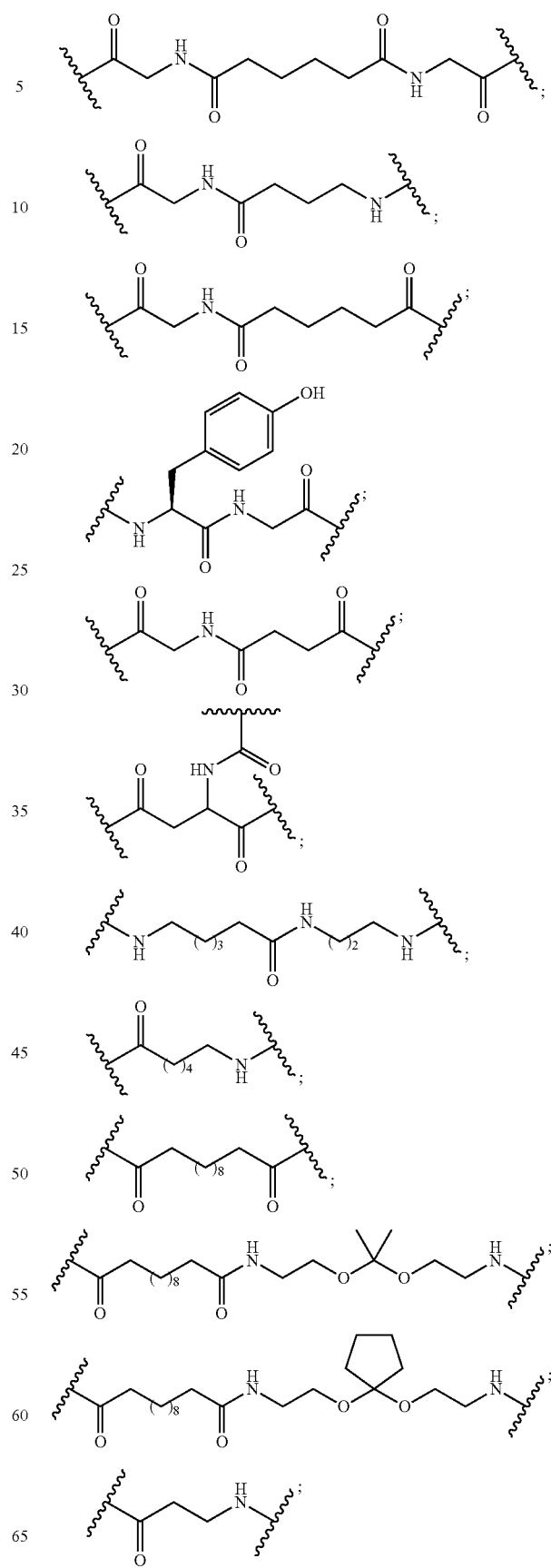
wherein each L is, independently, a phosphorus linking group or a neutral linking group; and
each n is, independently, from 1 to 20.
Embodiment 815
The conjugated antisense compound of any of embodiments 806 to 810, wherein the conjugate linker has a structure selected from among:

215
-continued

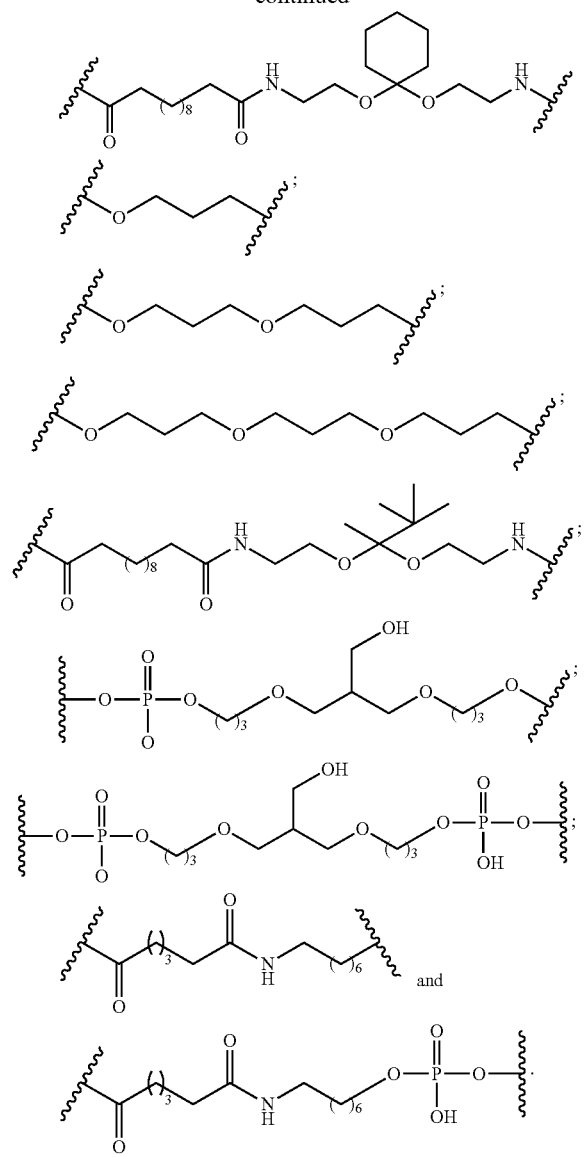

Embodiment 816

The conjugated antisense compound of any of embodiments 806 to 810, wherein the conjugate linker has the structure:

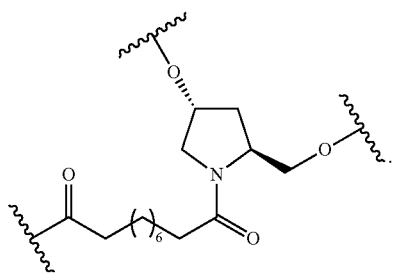

216

Embodiment 817

The conjugated antisense compound of any of embodiments 806 to 810, wherein the conjugate linker has one of the structures selected from:

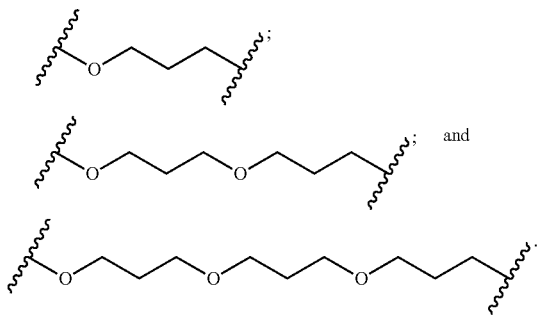

Embodiment 818

The conjugated antisense compound of any of embodiments 806 to 810, wherein the conjugate linker has one of the structures selected from:

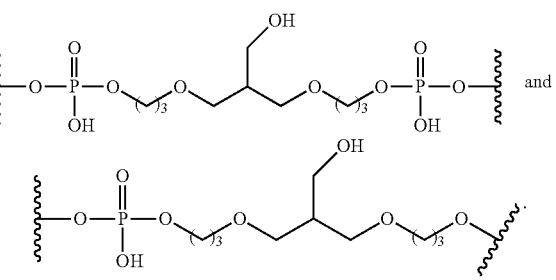

Embodiment 819

The conjugated antisense compound of any of embodiments 806 to 810, wherein the conjugate linker has one of the structures selected from:

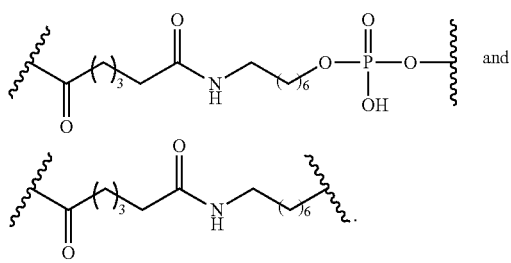

Embodiment 820

The conjugated antisense compound of any of embodiments 806 to 810, wherein the conjugate linker comprises a pyrrolidine.

Embodiment 821

The conjugated antisense compound of any of embodiments 806 to 810, wherein the conjugate linker does not comprise a pyrrolidine.

Embodiment 822

The conjugated antisense compound of any of embodiments 806 to 810, wherein the conjugate linker comprises PEG.

Embodiment 823

The conjugated antisense compound of any of embodiments 806 to 810, wherein the conjugate linker comprises an amide.

Embodiment 824

The conjugated antisense compound of any of embodiments 806 to 810, wherein the conjugate linker does not comprise an amide.

Embodiment 825

The conjugated antisense compound of any of embodiments 806 to 810, wherein the conjugate linker comprises a polyamide.

Embodiment 826

The conjugated antisense compound of any of embodiments 806 to 810, wherein the conjugate linker comprises an amine

Embodiment 827

The conjugated antisense compound of any of embodiments 806 to 810, wherein the conjugate linker comprises one or more disulfide bonds.

Embodiment 828

The conjugated antisense compound of any of embodiments 806 to 810, wherein the conjugate linker comprises a protein binding moiety.

Embodiment 829

The conjugated antisense compound of embodiment 828, wherein the protein binding moiety comprises a lipid.

Embodiment 830

The conjugated antisense compound of embodiment 829, wherein the protein binding moiety is selected from among: cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid.

Embodiment 831

The conjugated antisense compound of any of embodiments 828 to 830 wherein the protein binding moiety is a C16 to C22 long chain saturated or unsaturated fatty acid, cholesterol, cholic acid, vitamin E, adamantane or 1-pentafluoropropyl.

Embodiment 832

The conjugated antisense compound of any of embodiments 806 to 810, wherein the conjugate linker has a structure selected from among:

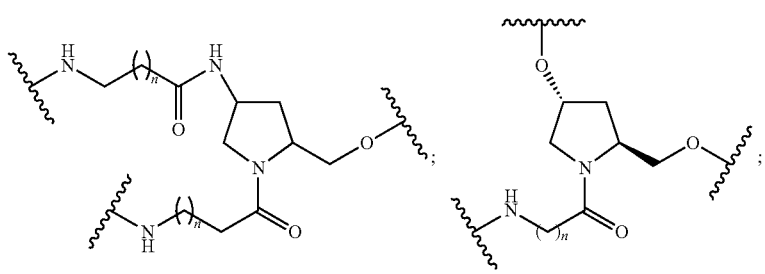

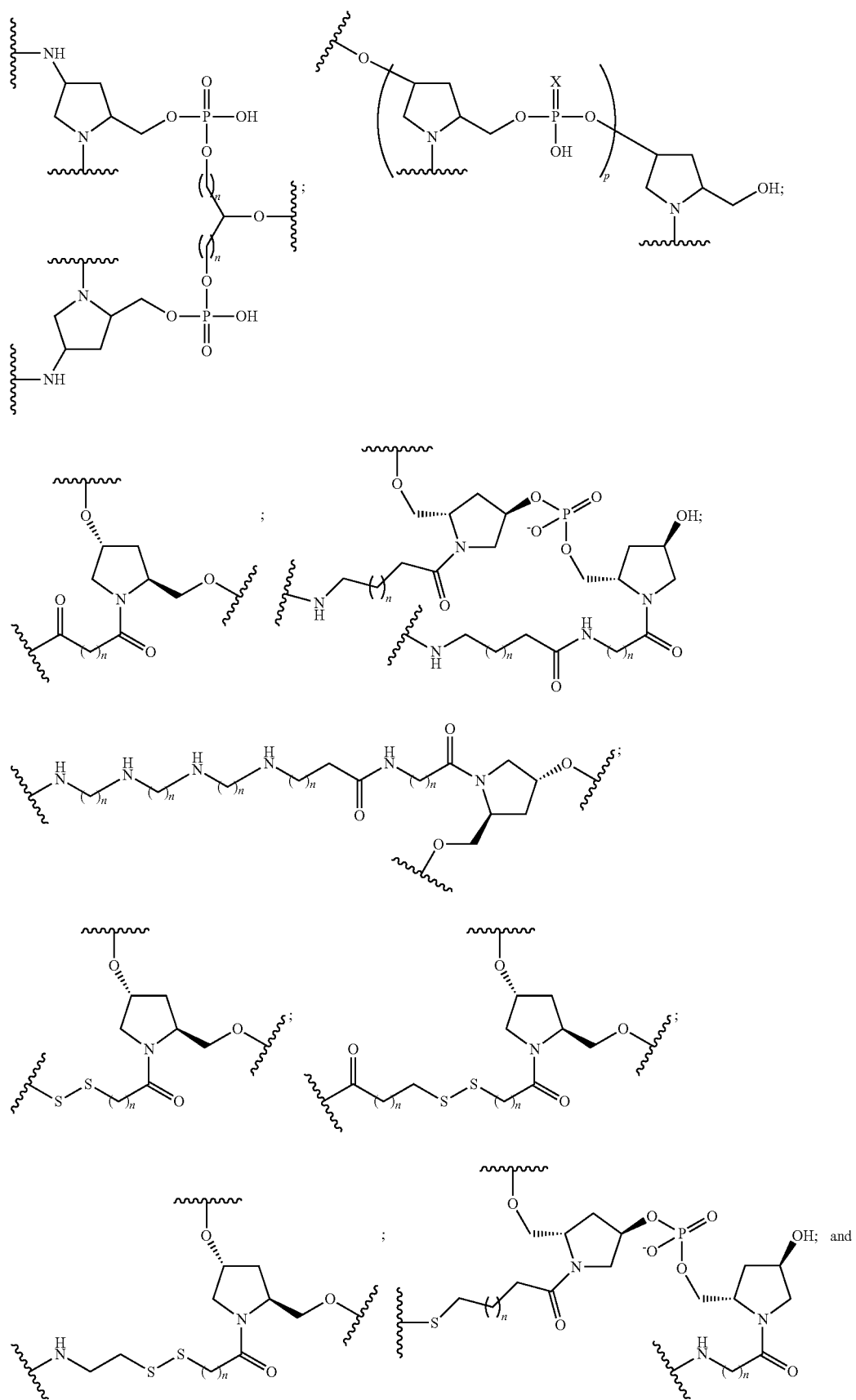

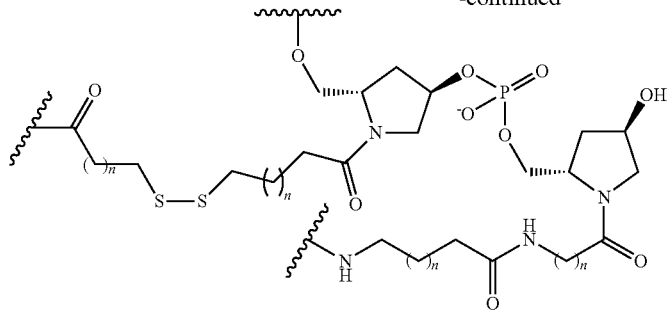
wherein each n is, independently, is from 1 to 20; and p is from 1 to 6.
Embodiment 833
The conjugated antisense compound of any of embodiments 806 to 810 wherein the conjugate linker has a structure selected from among:
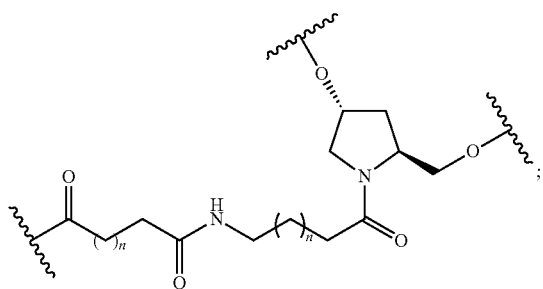
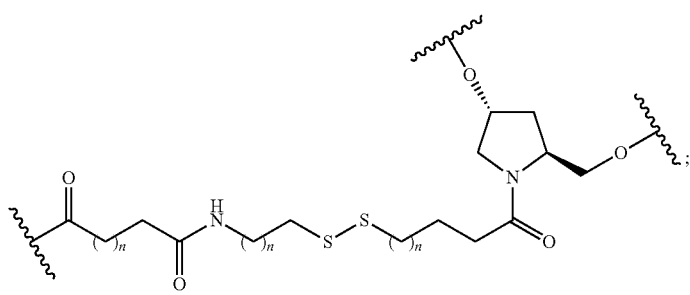
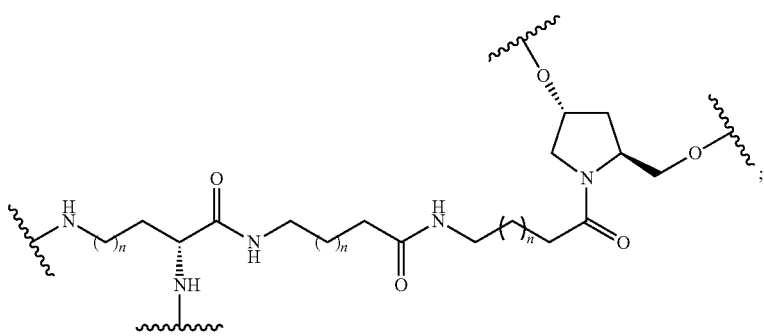

-continued
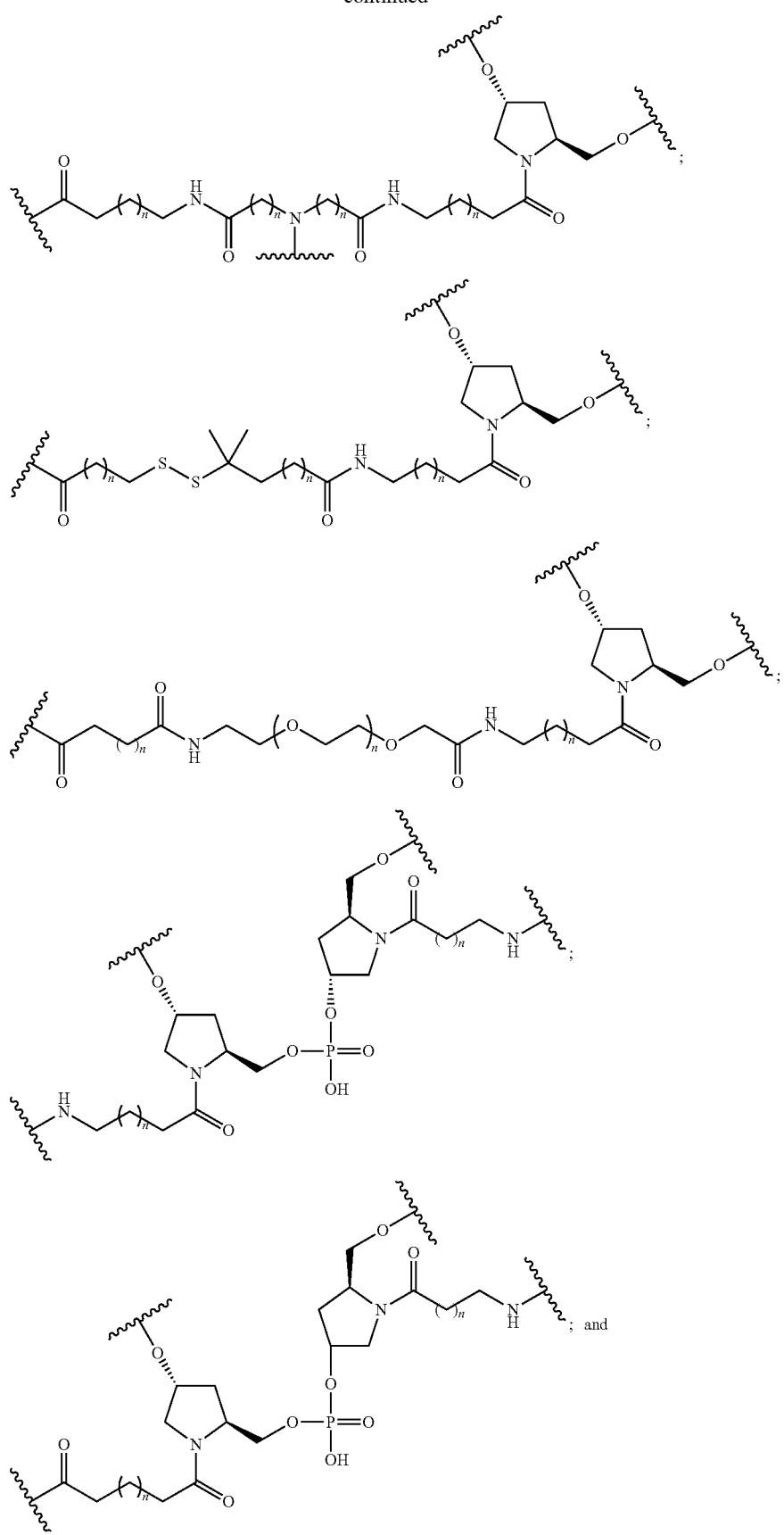

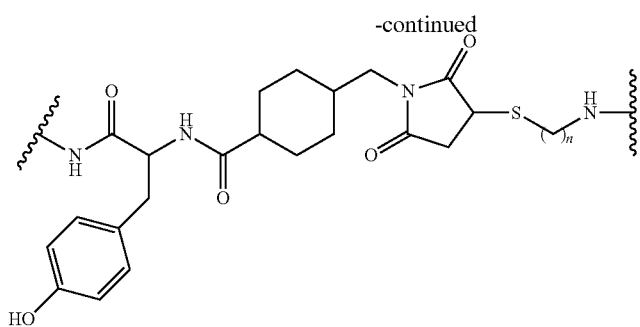
wherein each n is, independently, from 1 to 20.
Embodiment 834
The conjugated antisense compound of any of embodiments 806 to 810 wherein the conjugate linker has a structure selected from among:
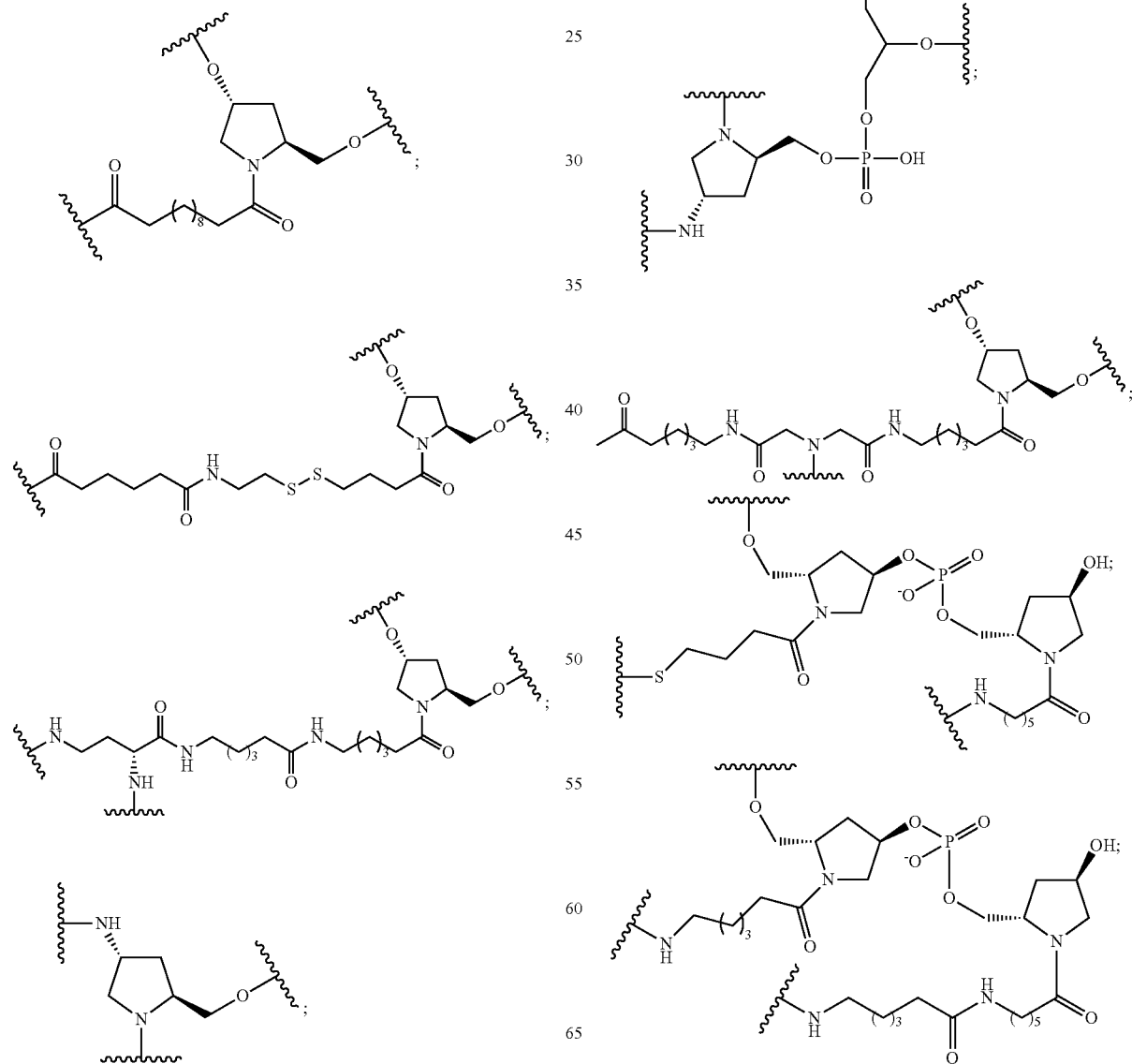

227
-continued
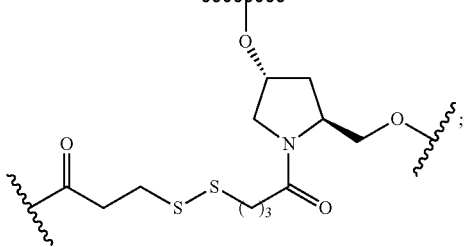
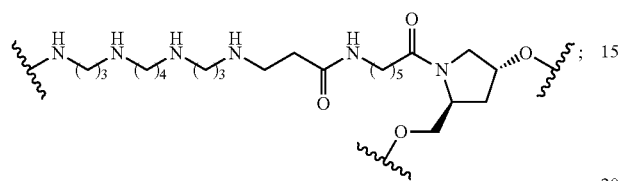
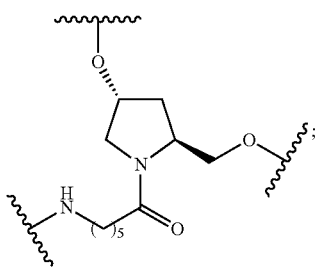
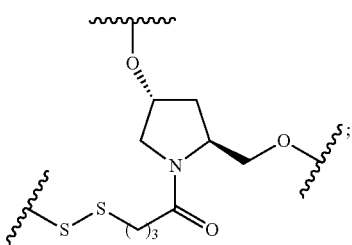
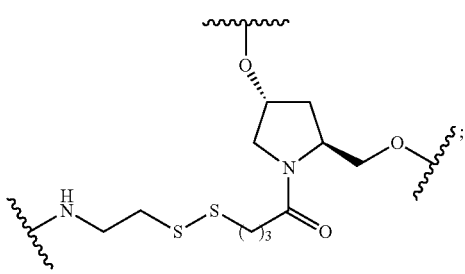
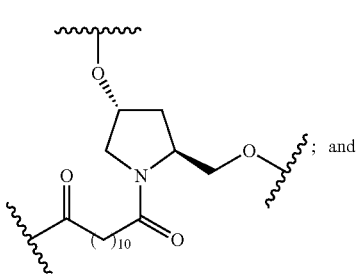
228
-continued
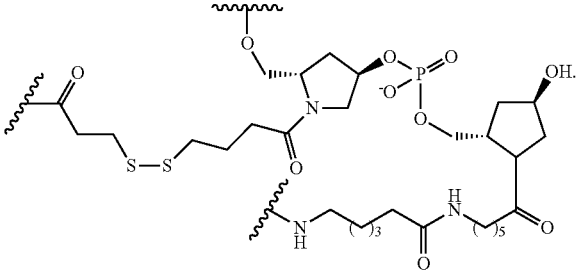
Embodiment 835
The conjugated antisense compound of any of embodiments 806 to 810 wherein the conjugate linker has a structure selected from among:
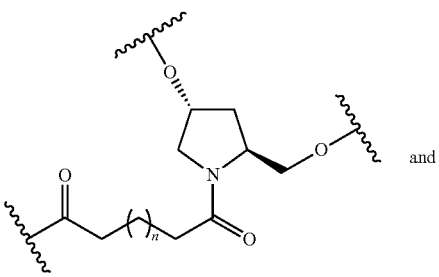
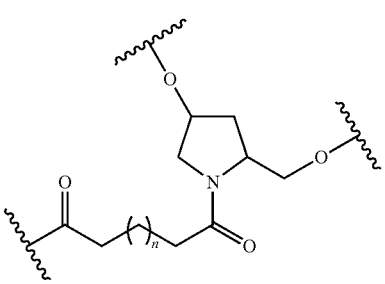
wherein n is from 1 to 20.
Embodiment 836
The conjugated antisense compound of embodiment 806 to 835, wherein the branching group has one of the following structures:
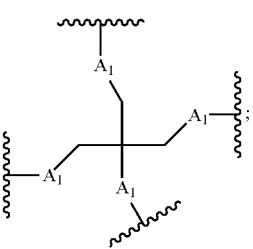

-continued

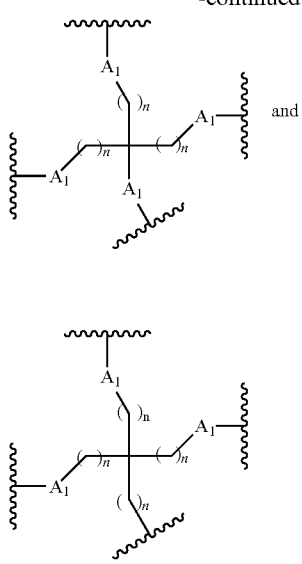

and wherein each $A_1$ is independently, O, S, C=O or NH; and each n is, independently, from 1 to 20.

Embodiment 837

The conjugated antisense compound of embodiment 806 to 835, wherein the branching group has one of the following structures:

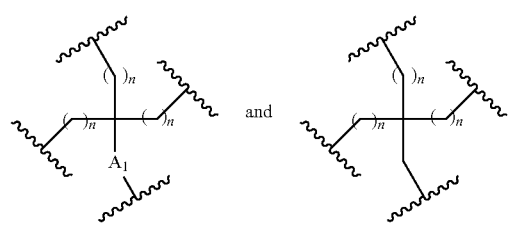

and wherein each $A_1$ is independently, O, S, C=O or NH; and each n is, independently, from 1 to 20.

Embodiment 838

The conjugated antisense compound of embodiment 806 to 835, wherein the branching group has the following structure:

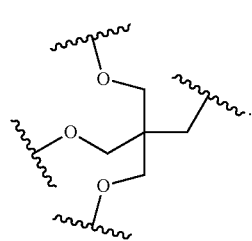 [SMILES: *CC(CO*)(CO*)CO*]

Embodiment 839

The conjugated antisense compound of embodiment 806 to 835, wherein the branching group has the following structure:

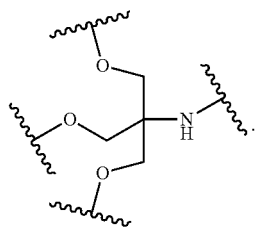 [SMILES: *NC(CO*)(CO*)CO*]

Embodiment 840

The conjugated antisense compound of embodiment 806 to 835, wherein the branching group has the following structure:

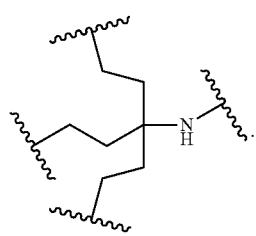 [SMILES: *CCC(CC*)(CC*)N*]

Embodiment 841

The conjugated antisense compound of embodiment 806 to 835, wherein the branching group has the following structure:

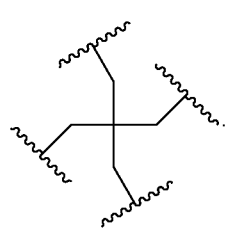 [SMILES: *CC(C*)(C*)C*]

Embodiment 842

The conjugated antisense compound of any of embodiments 806 to 835, wherein the branching group comprises an ether.

Embodiment 843

The conjugated antisense compound of embodiment 806 to 835, wherein the branching group has the following structure:

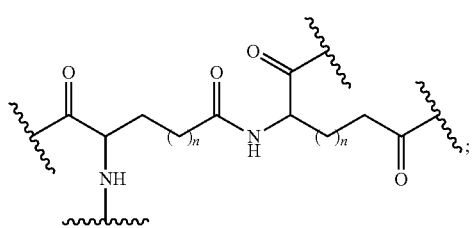
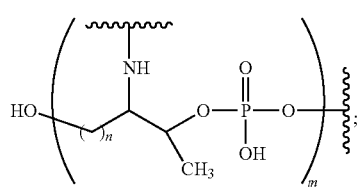
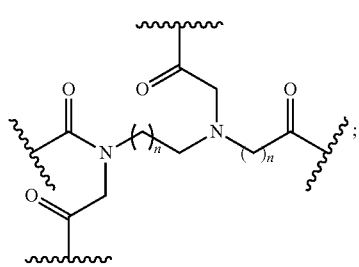
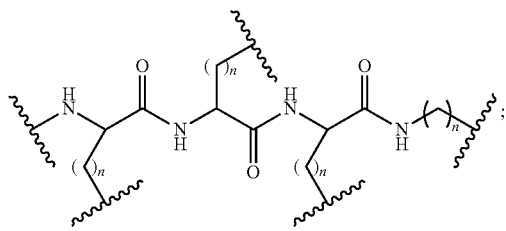
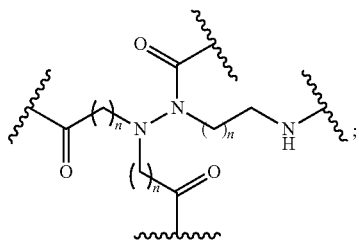
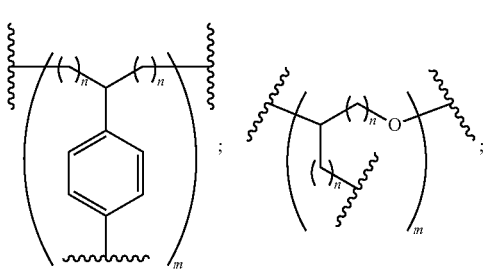
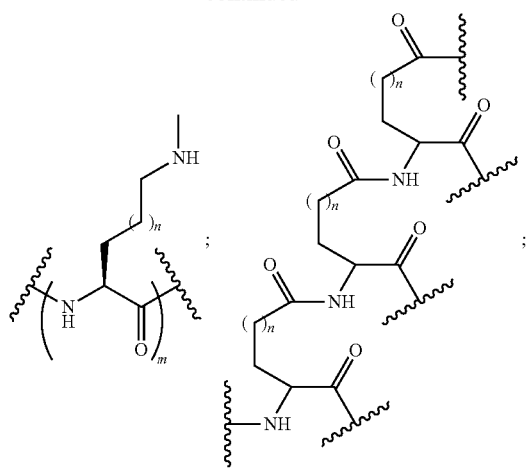
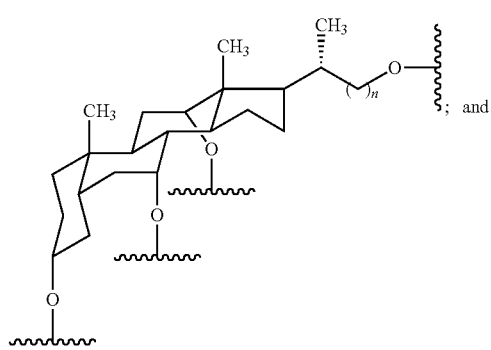
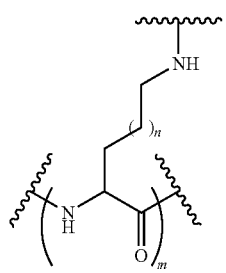
each n is, independently, from 1 to 20; and
m is from 2 to 6.
Embodiment 844
The conjugated antisense compound of embodiment 806 to 835, wherein the branching group has the following structure:
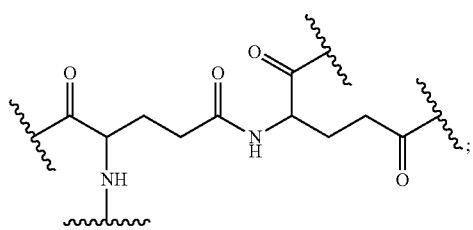

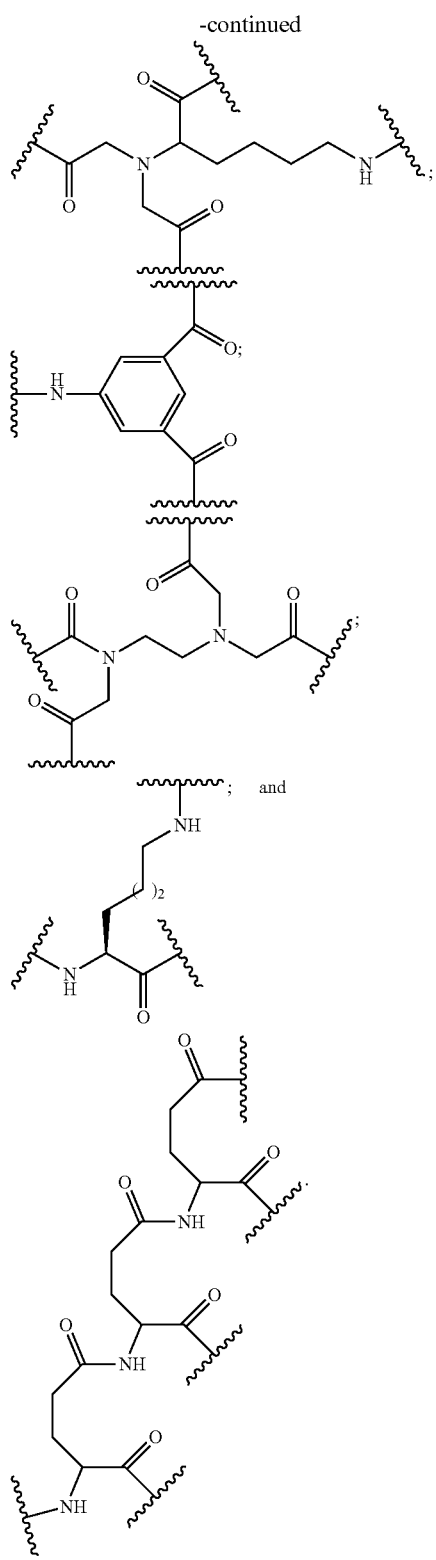
Embodiment 845
The conjugated antisense compound of embodiment 806 to 835, wherein the branching group has the following structure:
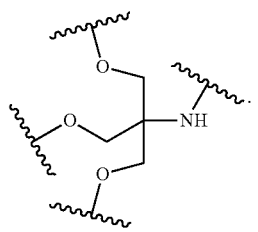 [SMILES: *NC(CO*)(CO*)CO*]
Embodiment 846
The conjugated antisense compound of any of embodiments 806 to 835, wherein the branching group comprises:
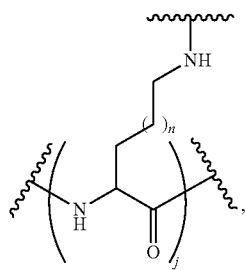
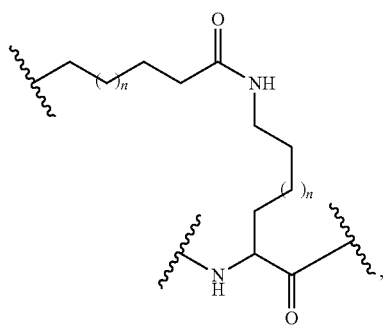
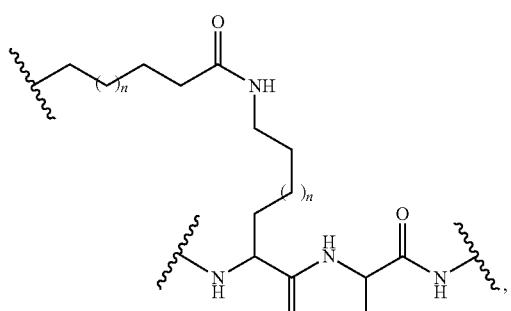

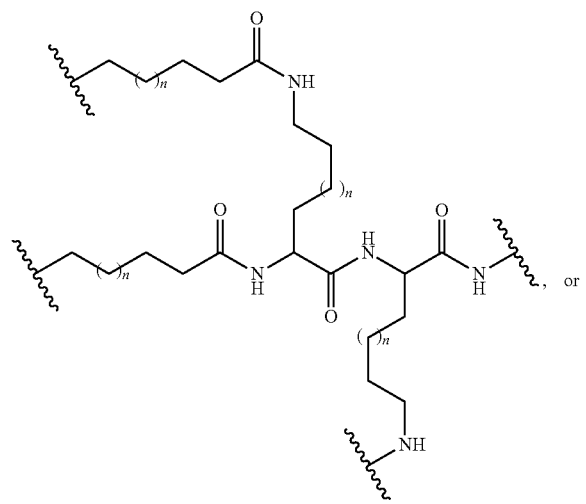
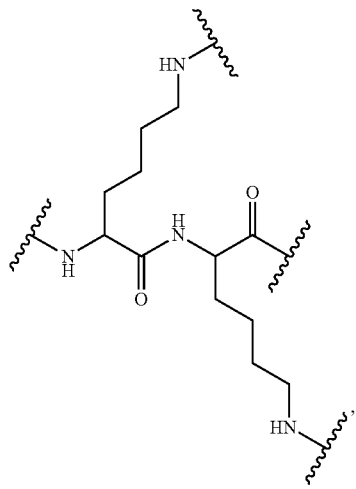
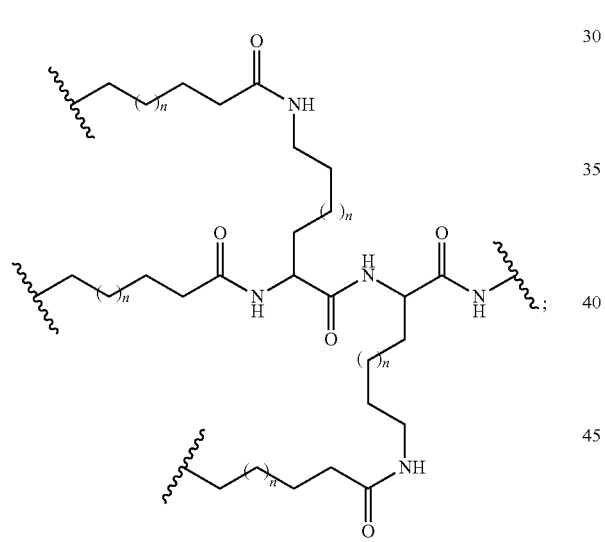
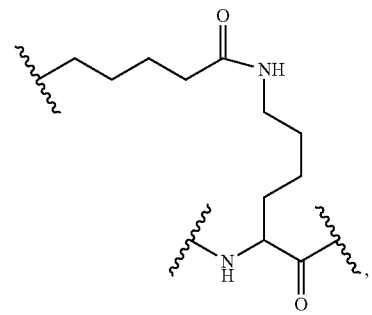
wherein each j is an integer from 1 to 3; and
wherein each n is an integer from 1 to 20.
Embodiment 847
The conjugated antisense compound of any of embodiments 806 to 835 wherein the branching group comprises:
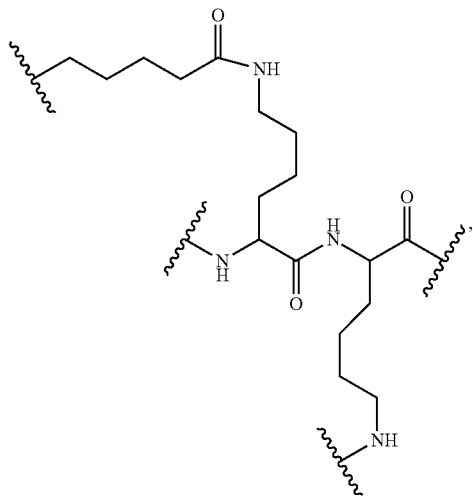

-continued

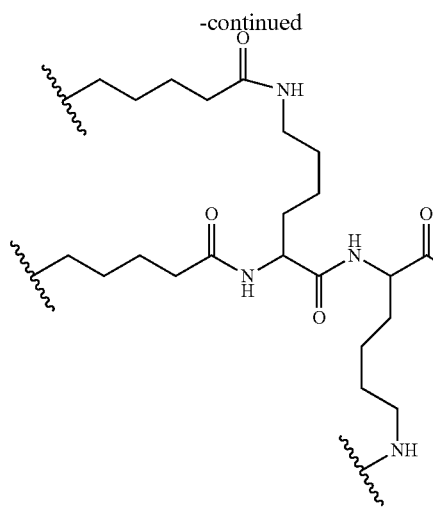

Embodiment 848

The conjugated antisense compound of embodiment 806 to 847, wherein each tether is selected from among:

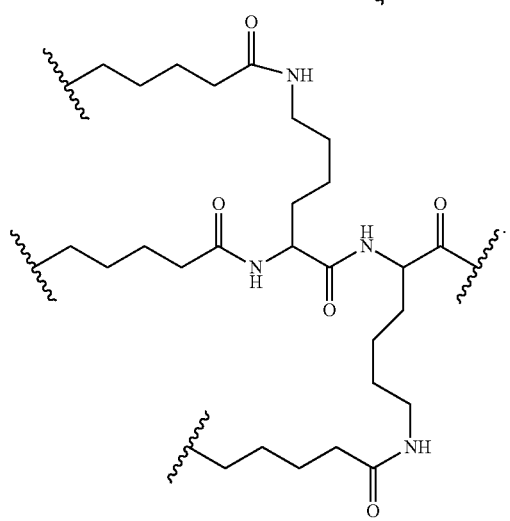

wherein L is selected from a phosphorus linking group and a neutral linking group;
$Z_1$ is C(=O)O—$R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

Embodiment 849

The conjugated antisense compound of embodiment 806 to 847, wherein each tether is selected from among:

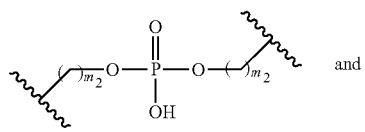

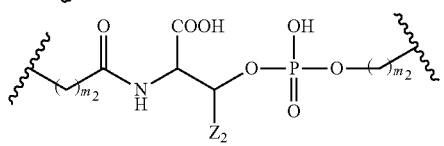

wherein $Z_2$ is H or $CH_3$; and
each $m_2$ is, independently, from 0 to 20 wherein at least one $m_2$ is greater than 0 for each tether.

Embodiment 850

The conjugated antisense compound of any of embodiments 806 to 847, wherein at least one tether comprises PEG.

Embodiment 851

The conjugated antisense compound of any of embodiments 806 to 847, wherein at least one tether comprises an amide.

Embodiment 852

The conjugated antisense compound of any of embodiments 806 to 847, wherein at least one tether comprises a polyamide.

Embodiment 853

The conjugated antisense compound of any of embodiments 806 to 847, wherein at least one tether comprises an amine Embodiment 854

The conjugated antisense compound of any of embodiments 806 to 847, wherein at least two tethers are different from one another.

Embodiment 855

The conjugated antisense compound of any of embodiments 806 to 847, wherein all of the tethers are the same as one another.

Embodiment 856

The conjugated antisense compound of any of embodiments 806 to 847, wherein each tether is selected from among:

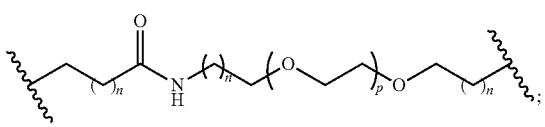

-continued

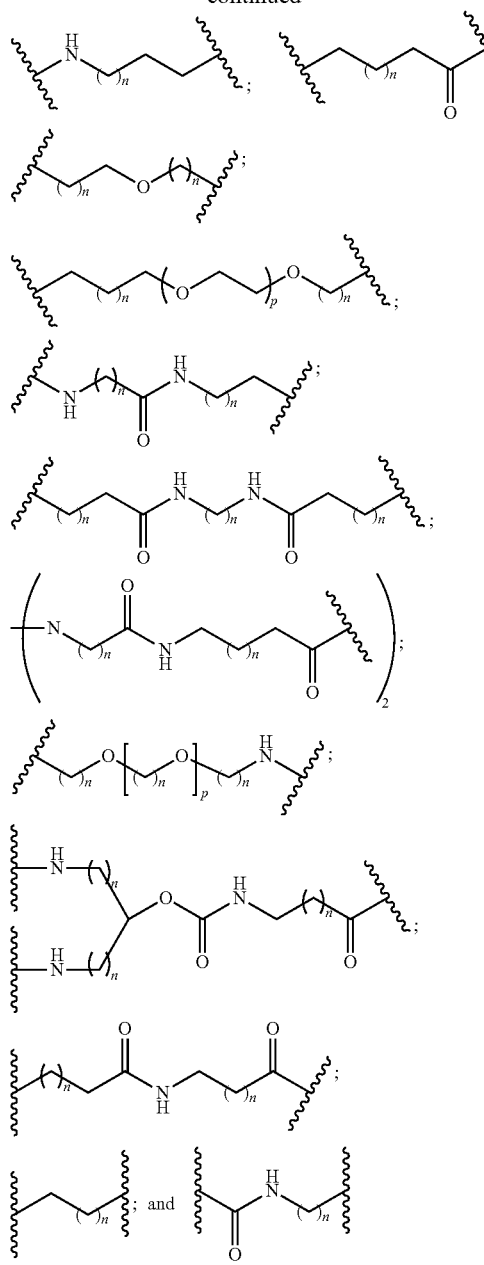

wherein each n is, independently, from 1 to 20; and
each p is from 1 to about 6.

Embodiment 857

The conjugated antisense compound of any of embodiments 806 to 847, wherein each tether is selected from among:

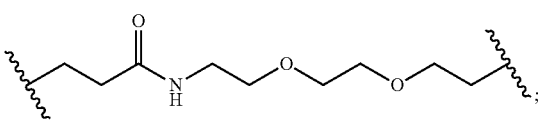

-continued

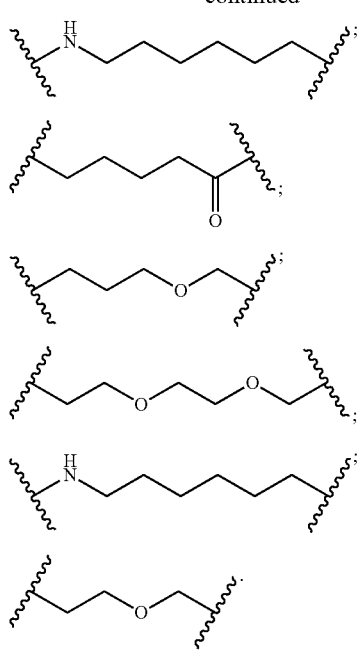

Embodiment 858

The conjugated antisense compound of any of embodiments 806 to 847, wherein each tether has the following structure:

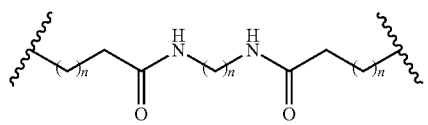

wherein each n is, independently, from 1 to 20.

Embodiment 859

The conjugated antisense compound of any of embodiments 806 to 847, wherein each tether has the following structure:

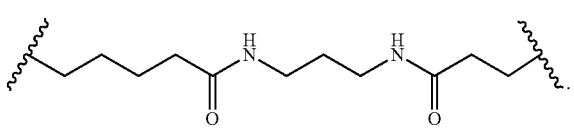 [SMILES: *CCCCC(=O)NCCCNC(=O)CC*]

Embodiment 860

The conjugated antisense compound of any of embodiments 806 to 860, wherein the conjugate group comprises a cell-targeting moiety having the following structure:

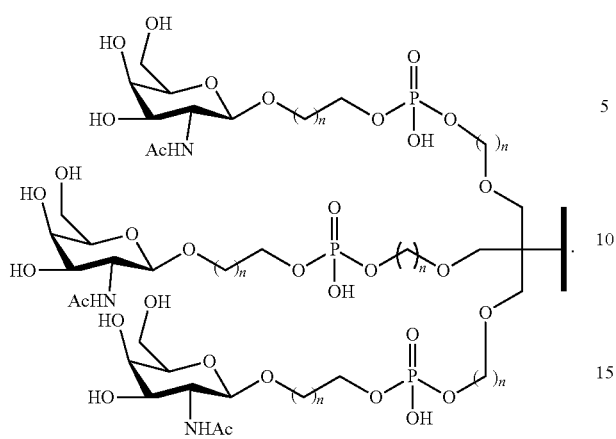

Embodiment 861

The conjugated antisense compound of any of embodiments 806 to 860, wherein the conjugate group comprises a cell-targeting moiety having the following structure:

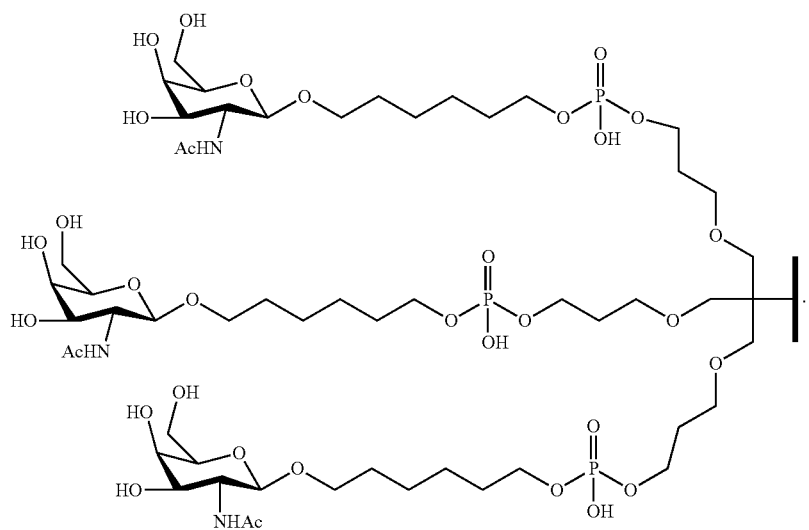

Embodiment 862

The conjugated antisense compound of any of embodiments 806 to 859, wherein the cell-targeting moiety comprises at least one ligand.

Embodiment 863

The conjugated antisense compound of any of embodiments 806 to 859, wherein the cell-targeting moiety comprises one ligand.

Embodiment 864

The conjugated antisense compound of any of embodiments 806 to 859, wherein the targeting moiety comprises two ligands.

Embodiment 865

The conjugated antisense compound of any of embodiments 806 to 859, wherein the targeting moiety comprises three ligands.

Embodiment 866

The conjugated antisense compound of any of embodiments 806 to 859, wherein each ligand is covalently attached to each tether.

Embodiment 867

The conjugated antisense compound of any of embodiments 862 to 866, wherein at least one ligand is N-Acetylgalactosamine (GalNAc).

Embodiment 868

The conjugated antisense compound of any of embodiments 862 to 866, wherein each ligand is N-Acetylgalactosamine (GalNAc).

Embodiment 869

The conjugated antisense compound of any of embodiments 862 to 866, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, β-D-Mannofuranose, α-D-Mannopyranose, β-D-Mannopyranose, α-D-Glucopyranose, 3-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2- deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 870

The conjugated antisense compound of any of embodiments 862 to 866, wherein the ligand is galactose.

Embodiment 871

The conjugated antisense compound of any of embodiments 862 to 866, wherein the ligand is mannose-6-phosphate.

Embodiment 872

The conjugated antisense compound of any of embodiments 862 to 866, wherein each ligand is selected from among:

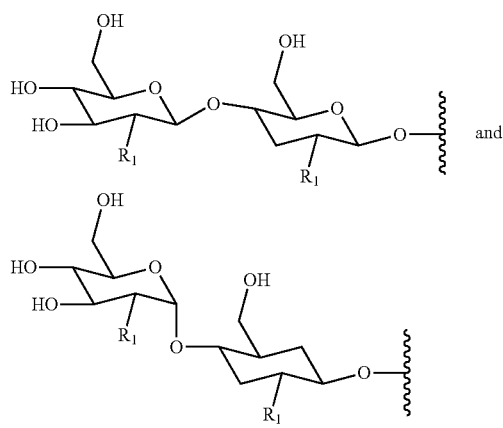
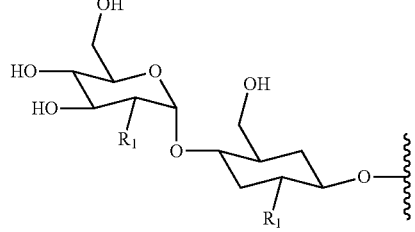

wherein each R₁ is selected from OH and NHCOOH.

Embodiment 873

The conjugated antisense compound of any of embodiments 862 to 866, wherein each ligand is selected from among:

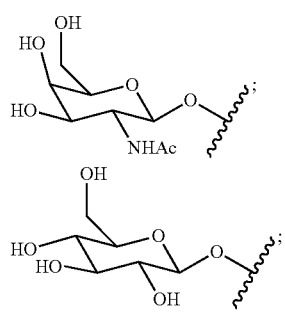
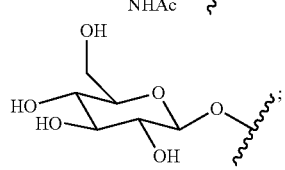

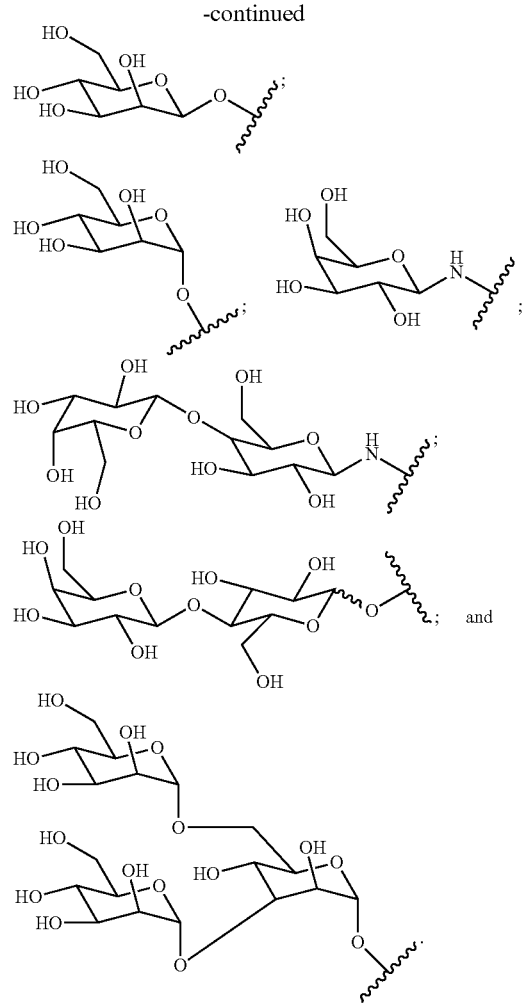

Embodiment 874

The conjugated antisense compound of any of embodiments 862 to 866, wherein each ligand has the following structure:

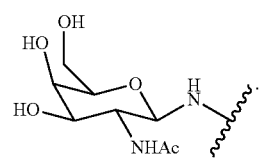 [SMILES: *OC1OC(CO)C(O)C(O)C1NC(C)=O]

Embodiment 875

The conjugated antisense compound of any of embodiments 862 to 866, wherein each ligand has the following structure:

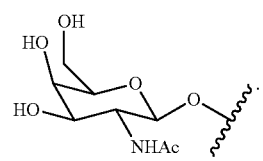

Embodiment 876

The conjugated antisense compound of any of embodiments 806 to 860, wherein the conjugate group comprises a cell-targeting moiety having the following structure:

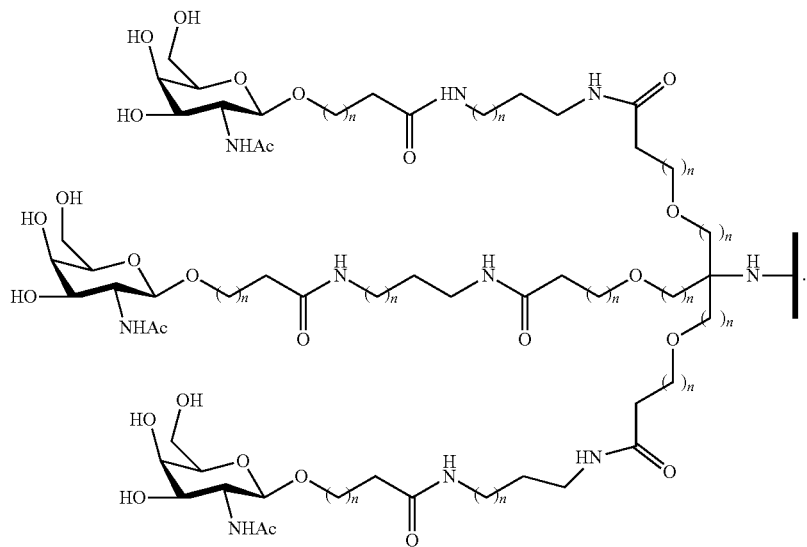

wherein each n is, independently, from 1 to 20.

Embodiment 877

The conjugated antisense compound of any of embodiments 806 to 860, wherein the conjugate group comprises a cell-targeting moiety having the following structure:

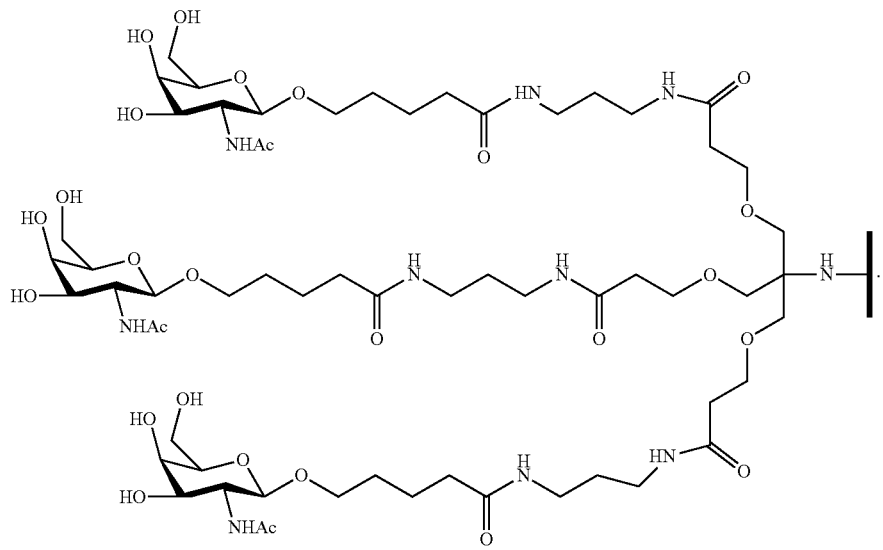

Embodiment 878
The conjugated antisense compound of any of embodiments 806 to 860, wherein the conjugate group comprises a cell-targeting moiety having the following structure:
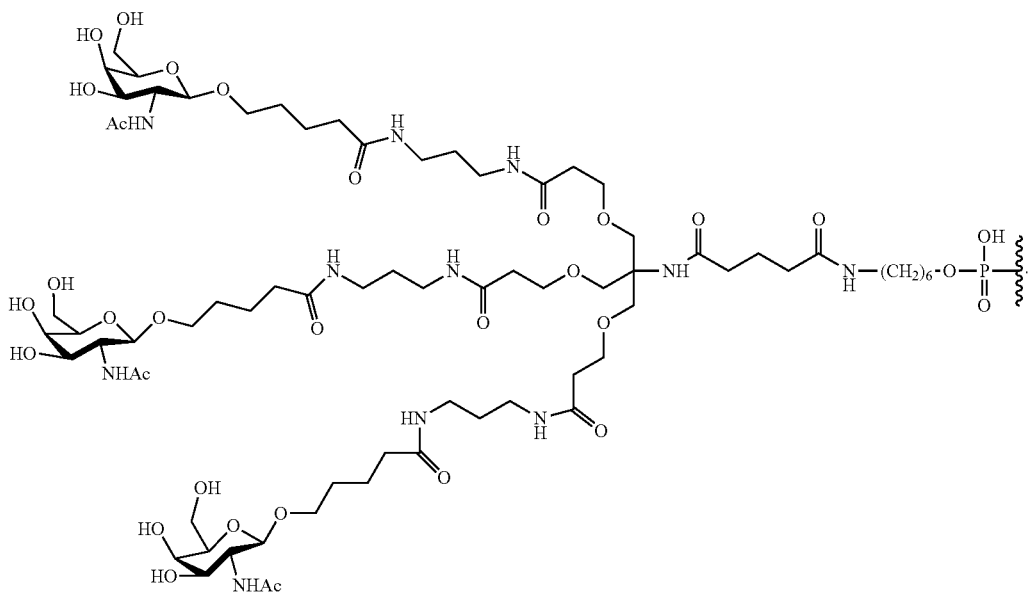
Embodiment 879
The conjugated antisense compound of any of embodiments 806 to 860, wherein the conjugate group comprises a cell-targeting moiety having the following structure:
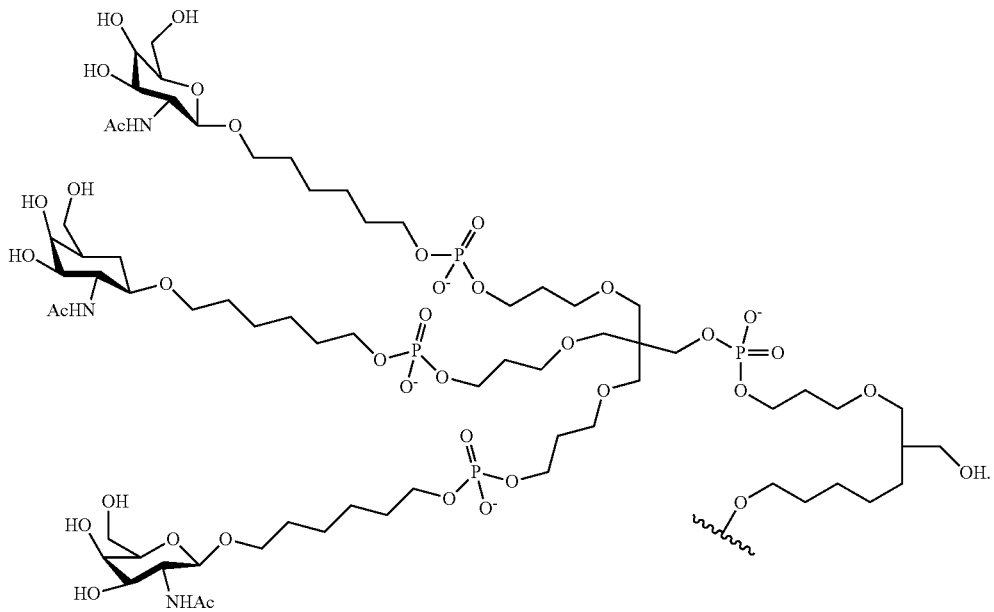

Embodiment 880
The conjugated antisense compound of any of embodiments 806 to 860, wherein the conjugate group comprises a cell-targeting moiety having the following structure:
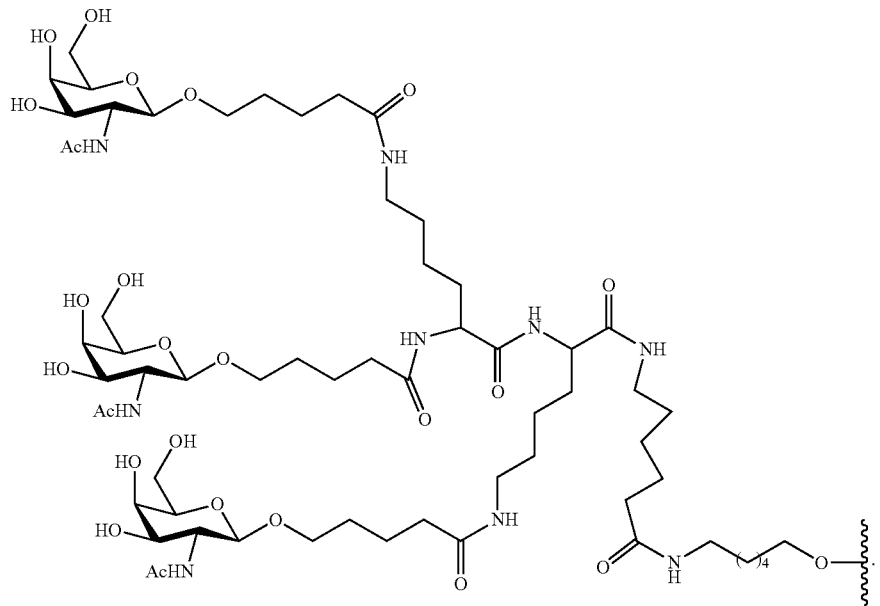
Embodiment 881
The conjugated antisense compound of any of embodiments 806 to 860, wherein the conjugate group comprises a cell-targeting moiety having the following structure:
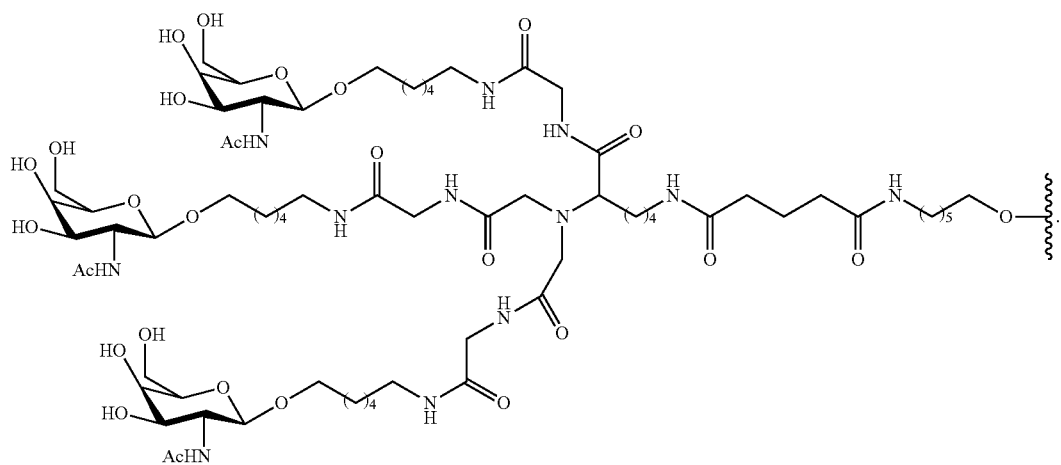

Embodiment 882
The conjugated antisense compound of any of embodiments 806 to 860, wherein the conjugate group comprises a cell-targeting moiety having the following structure:
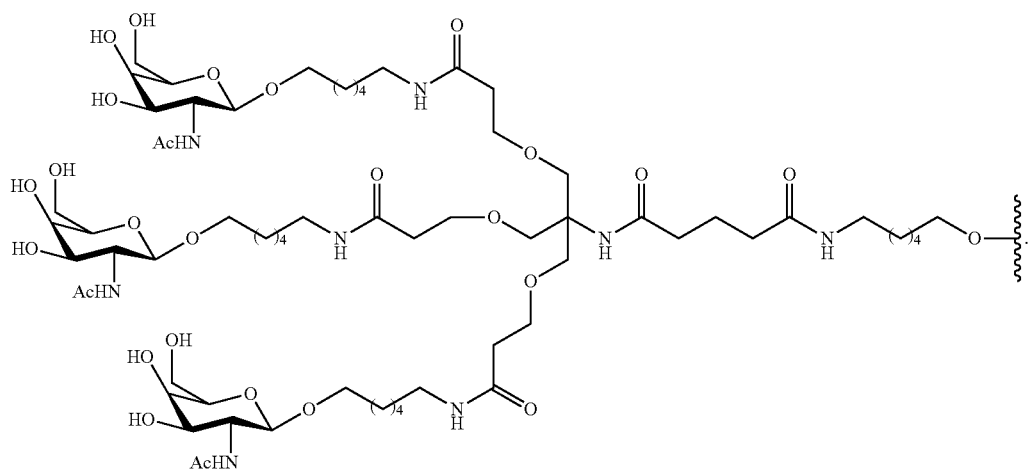
Embodiment 883
The conjugated antisense compound of any of embodiments 806 to 860, wherein the conjugate group comprises a cell-targeting moiety having the following structure:
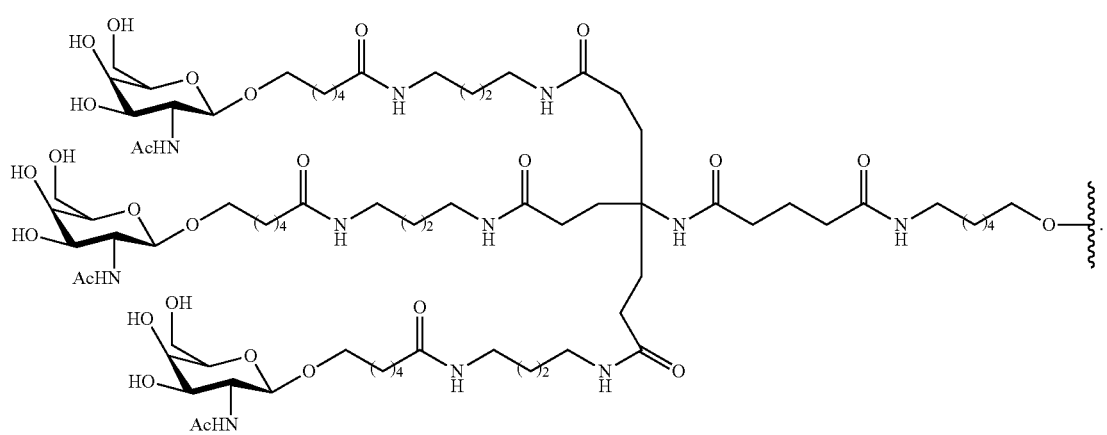

Embodiment 884
The conjugated antisense compound of any of embodiments 806 to 860, wherein the conjugate group comprises a cell-targeting moiety having the following structure:
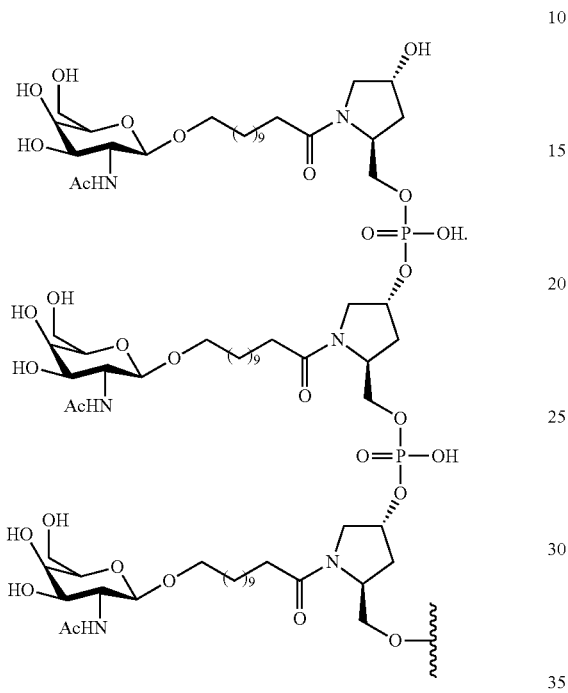
Embodiment 885
The conjugated antisense compound of any of embodiments 806 to 860, wherein the conjugate group comprises a cell-targeting moiety having the following structure:
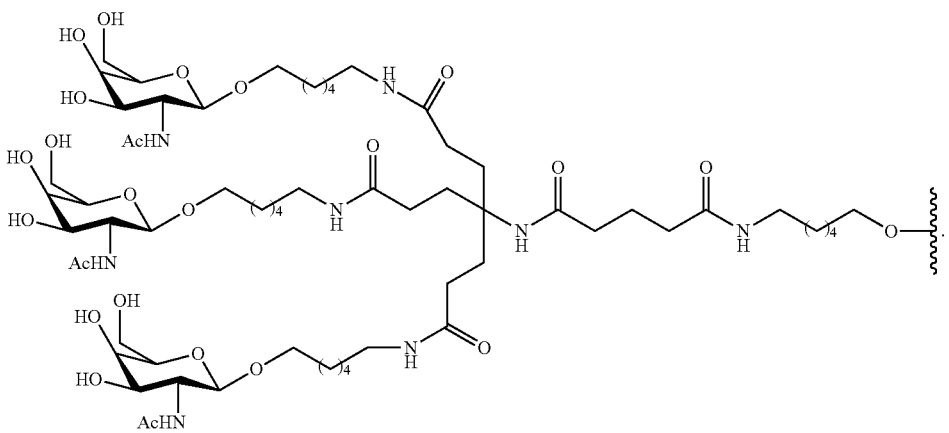

Embodiment 886

The conjugated antisense compound of any of embodiments 806 to 860, wherein the conjugate group comprises a cell-targeting moiety having the following structure:

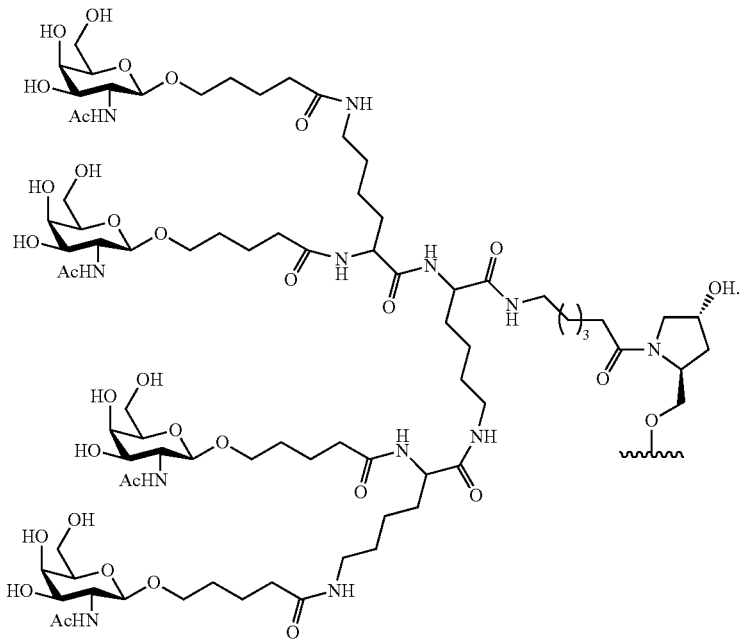

Embodiment 887

The conjugated antisense compound of any of embodiments 779 to 789, wherein the conjugate group has the following structure:

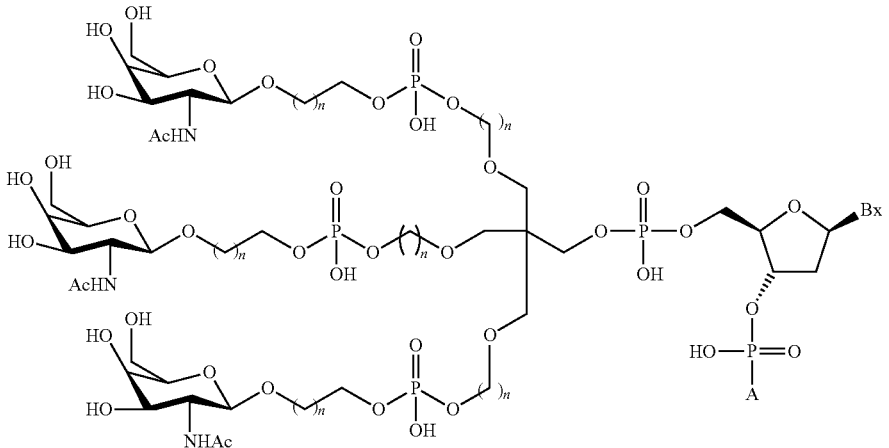

wherein each n is, independently, from 1 to 20;
A is the antisense oligonucleotide; and
Bx is a heterocyclic base moiety.

Embodiment 888

The conjugated antisense compound of any of embodiments 779 to 789, wherein the conjugate group has the following structure:

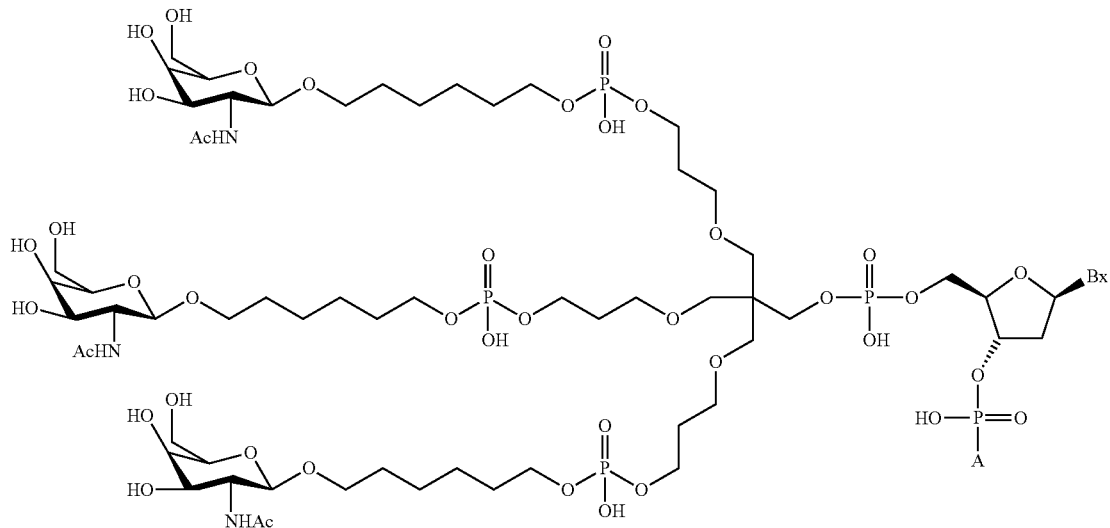

wherein each n is, independently, from 1 to 20;
A is the antisense oligonucleotide; and
Bx is a heterocyclic base moiety.

Embodiment 889

The conjugated antisense compound of any of embodiments 779 to 789, wherein the conjugate group has the following structure:

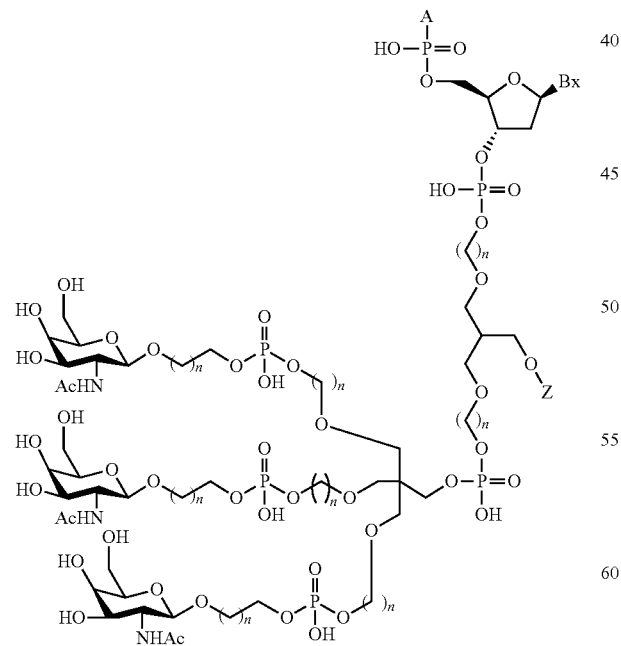

wherein each n is, independently, from 1 to 20;
A is the antisense oligonucleotide;
Z is H or a linked solid support; and
Bx is a heterocyclic base moiety.

Embodiment 890

The conjugated antisense compound of any of embodiments 779 to 789, wherein the conjugate group has the following structure:

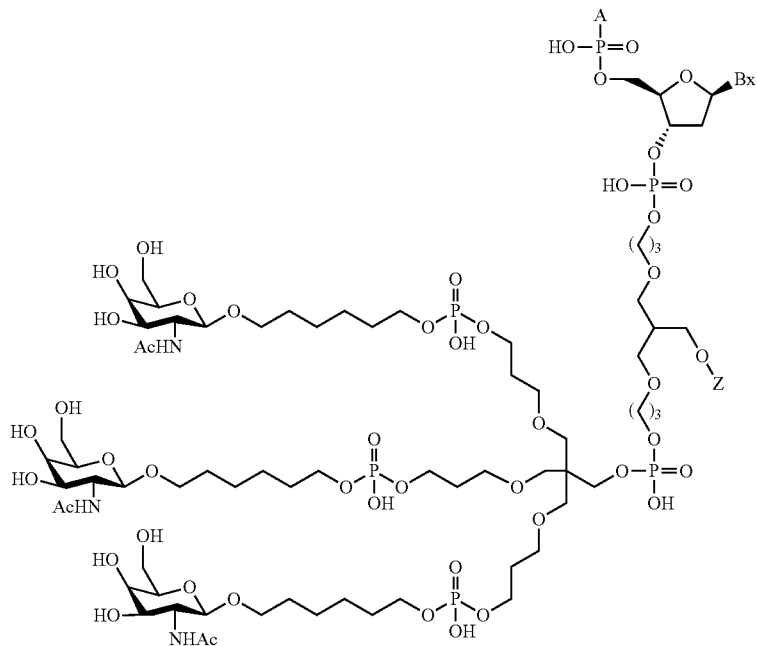

wherein each n is, independently, from 1 to 20;
A is the antisense oligonucleotide;
Z is H or a linked solid support; and
Bx is a heterocyclic base moiety.

Embodiment 891

The conjugated antisense compound of any of any of embodiments 779 to 789, wherein the conjugate group has the following structure:

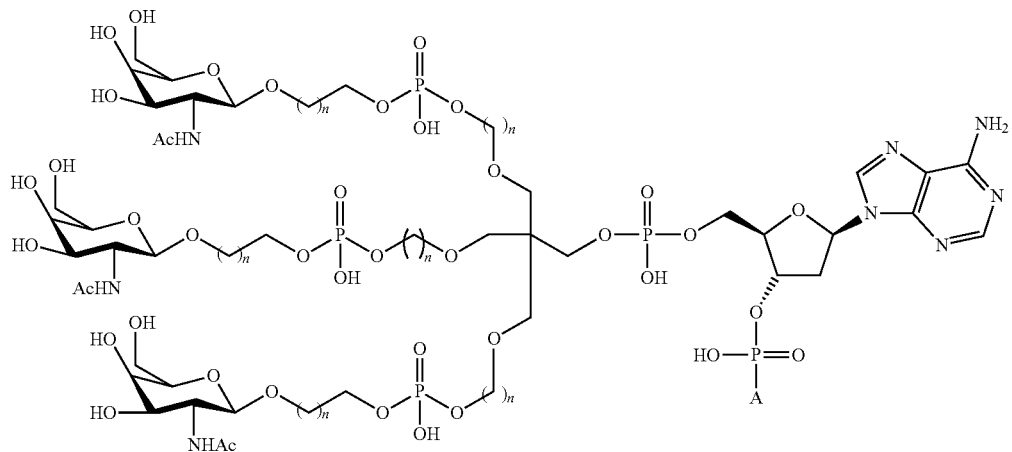

wherein A is the antisense oligonucleotide.

Embodiment 892

The conjugated antisense compound of any of embodiments 779 to 789, wherein the conjugate group has the following structure:

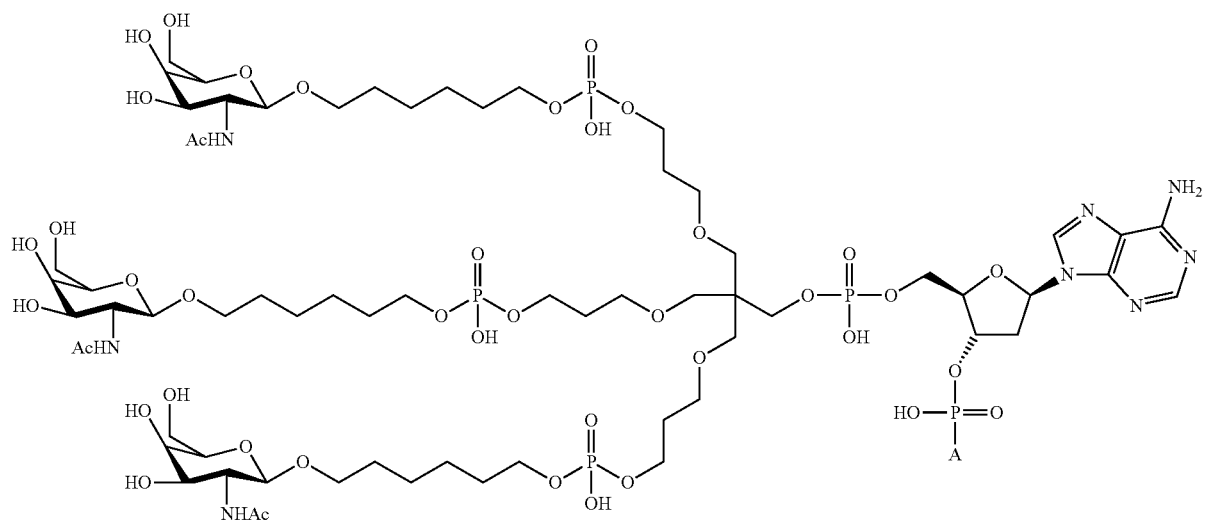

wherein A is the antisense oligonucleotide.

Embodiment 893

The conjugated antisense compound of any of embodiments 779 to 789, wherein the conjugate group has the following structure:

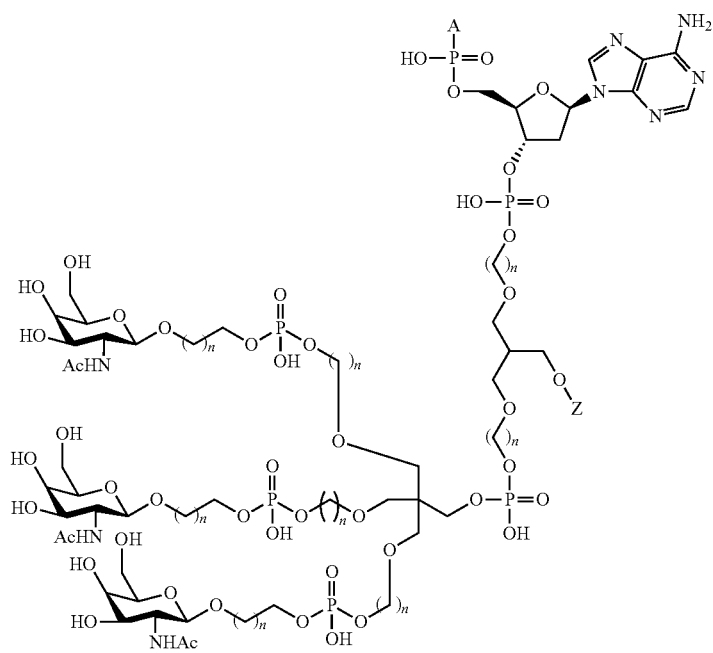

wherein A is the antisense oligonucleotide; and
Z is H or a linked solid support.

Embodiment 894

The conjugated antisense compound of any of embodiments 779 to 789, wherein the conjugate group has the following structure:

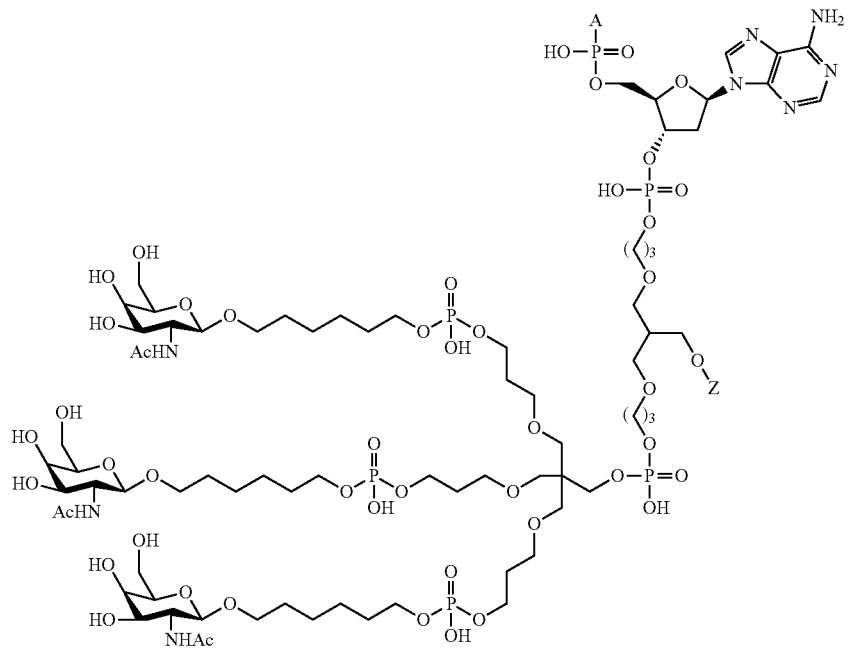

wherein A is the antisense oligonucleotide; and
Z is H or a linked solid support.

Embodiment 895

The conjugated antisense compound of any of embodiments 779 to 789, wherein the conjugate group has the following structure:

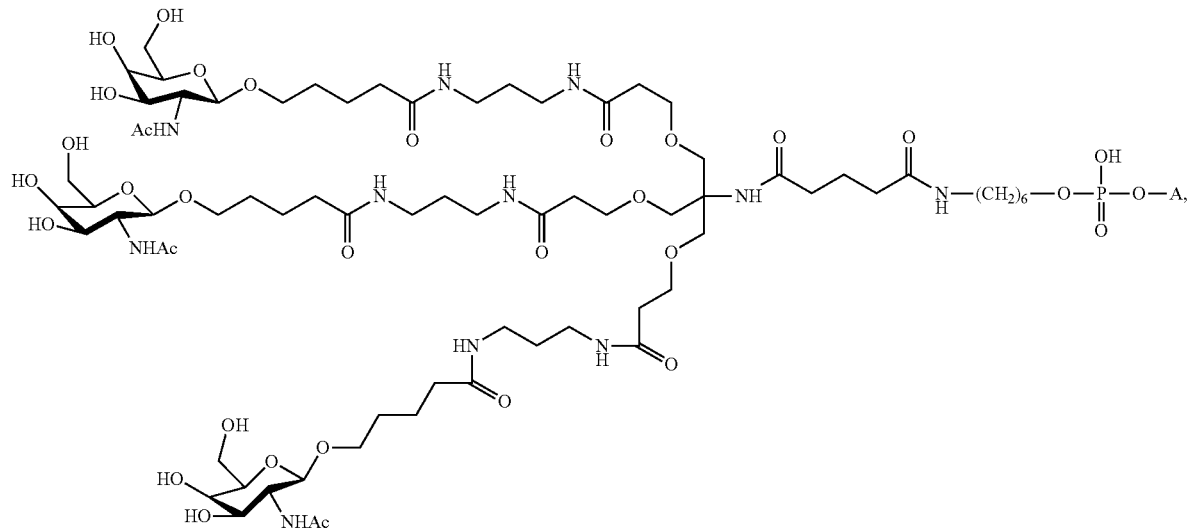

and wherein A is the antisense oligonucleotide.

Embodiment 896
The conjugated antisense compound of any of embodiments 779 to 789, wherein the conjugate group has the following structure:
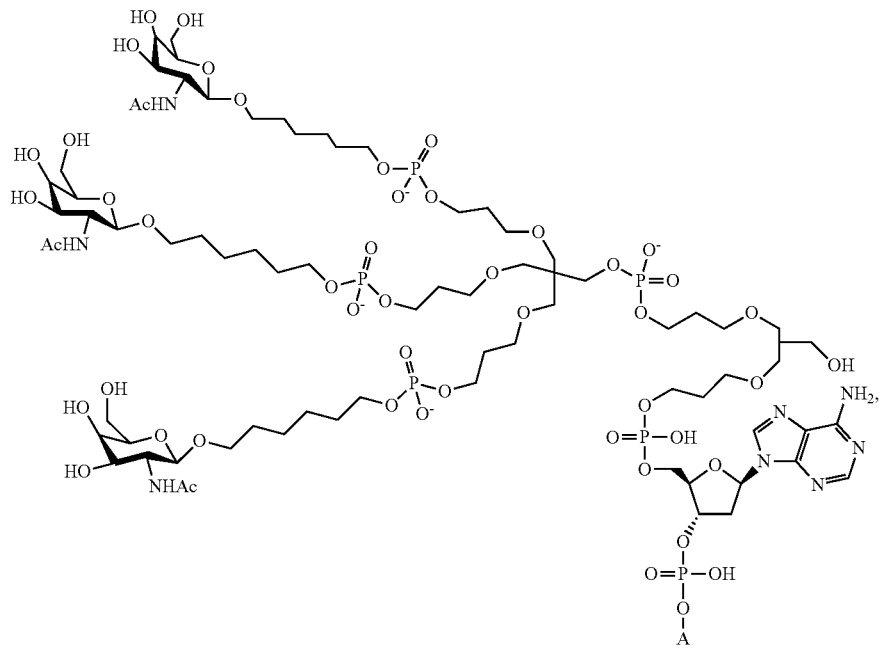
wherein A is the antisense oligonucleotide.
Embodiment 897
The conjugated antisense compound of any of embodiments 779 to 789, wherein the conjugate group has the following structure:
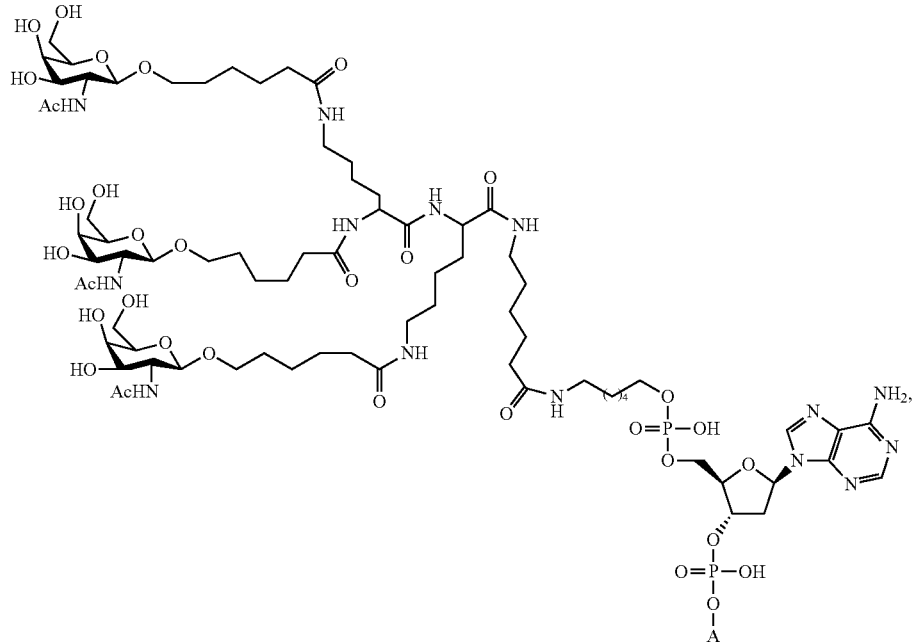
and wherein
A is the antisense oligonucleotide.

Embodiment 898
The conjugated antisense compound of any of embodiments 779 to 789, wherein the conjugate group has the following structure:
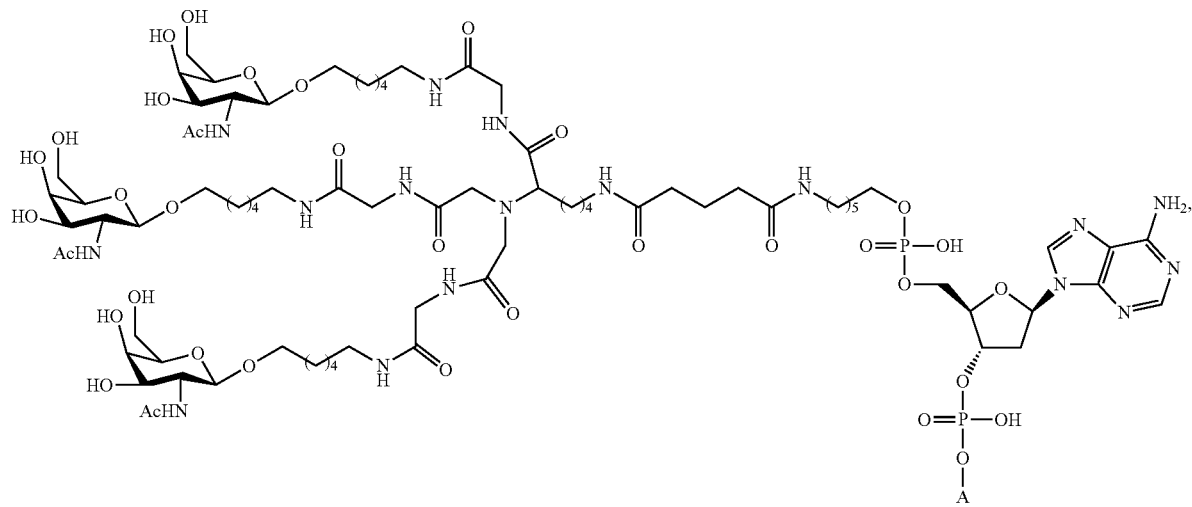
and wherein A is the antisense oligonucleotide.
Embodiment 899
The conjugated antisense compound of any of embodiments 779 to 789, wherein the conjugate group has the following structure:
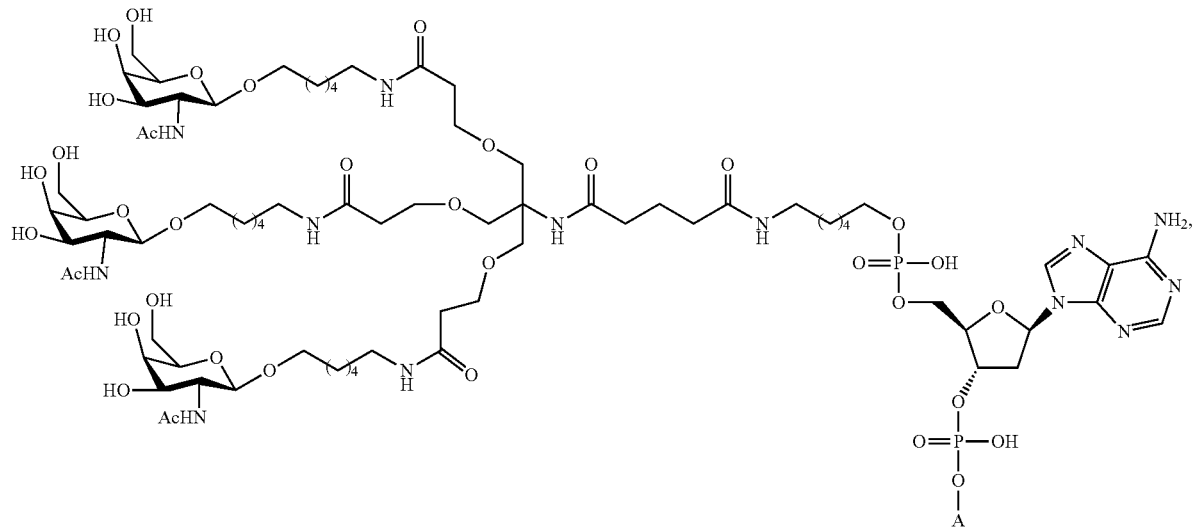
and wherein A is the antisense oligonucleotide.

Embodiment 900
The conjugated antisense compound of any of embodiments 779 to 789, wherein the conjugate group has the following structure:
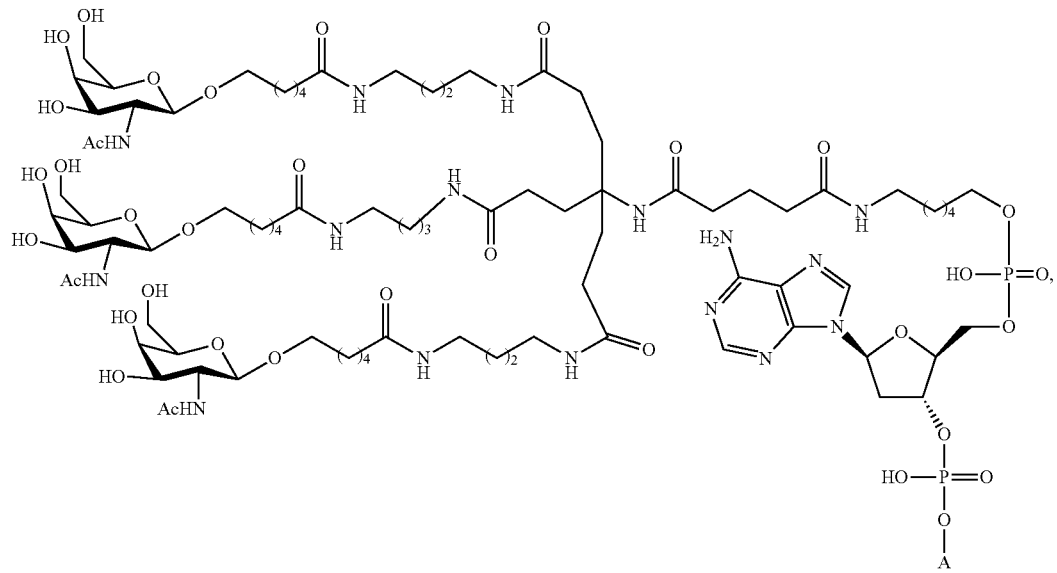
wherein A is the antisense oligonucleotide.
Embodiment 901
The conjugated antisense compound of any of embodiments 779 to 789, wherein the conjugate group has the following structure:
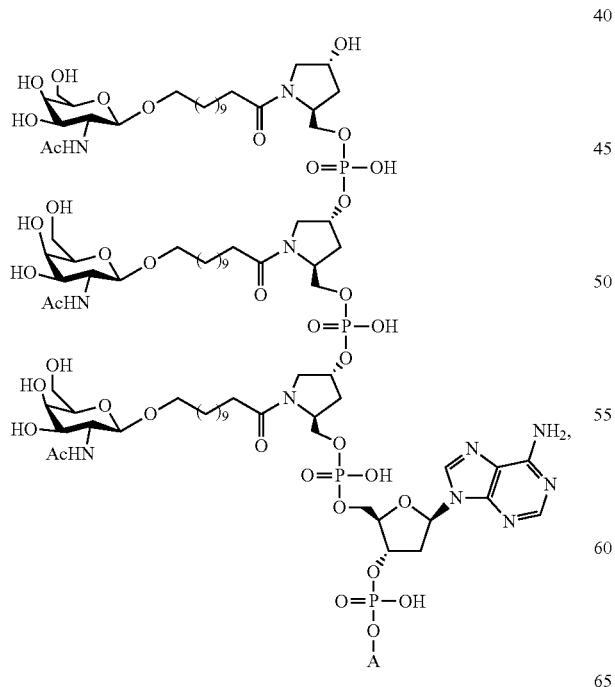
and wherein A is the antisense oligonucleotide.

Embodiment 902
The conjugated antisense compound of any of embodiments 779 to 789, wherein the conjugate group has the following structure:
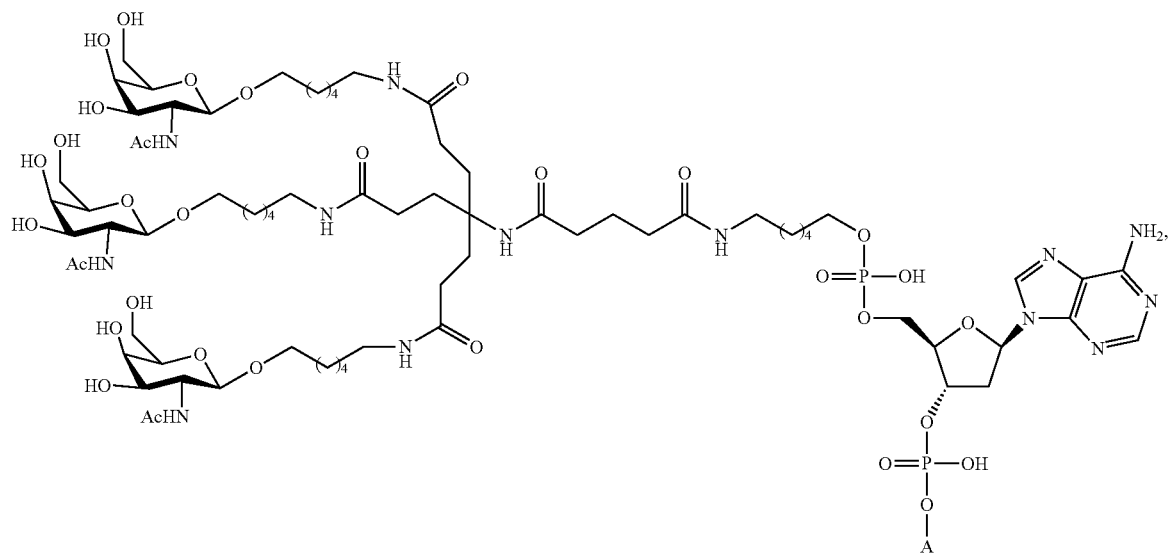
and
wherein A is the antisense oligonucleotide.
Embodiment 903
The conjugated antisense compound of any of embodiments 779 to 789, wherein the conjugate group has the following structure:
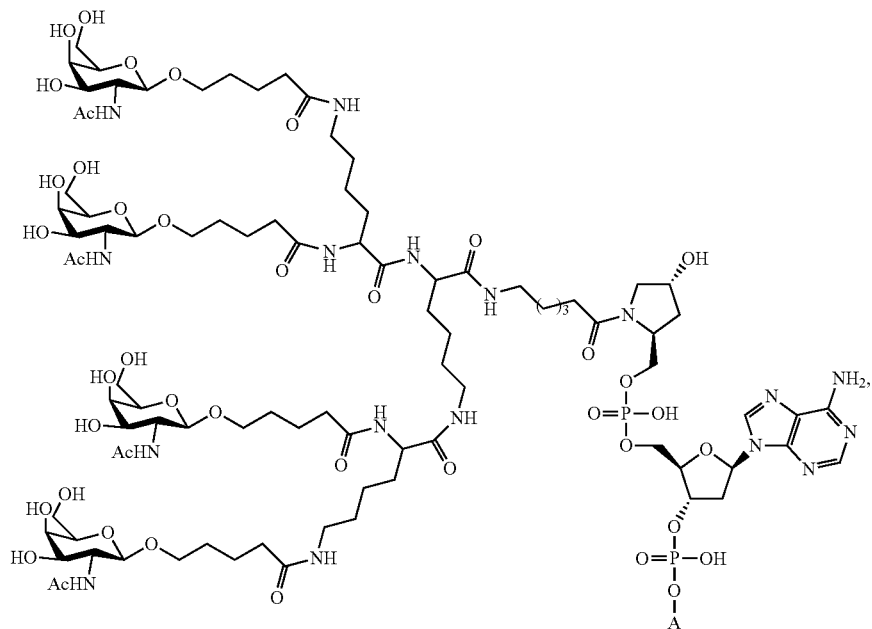
and wherein
A is the antisense oligonucleotide.

Embodiment 904
The conjugated antisense compound of any of embodiments 779 to 789, wherein the conjugate group has the following structure:
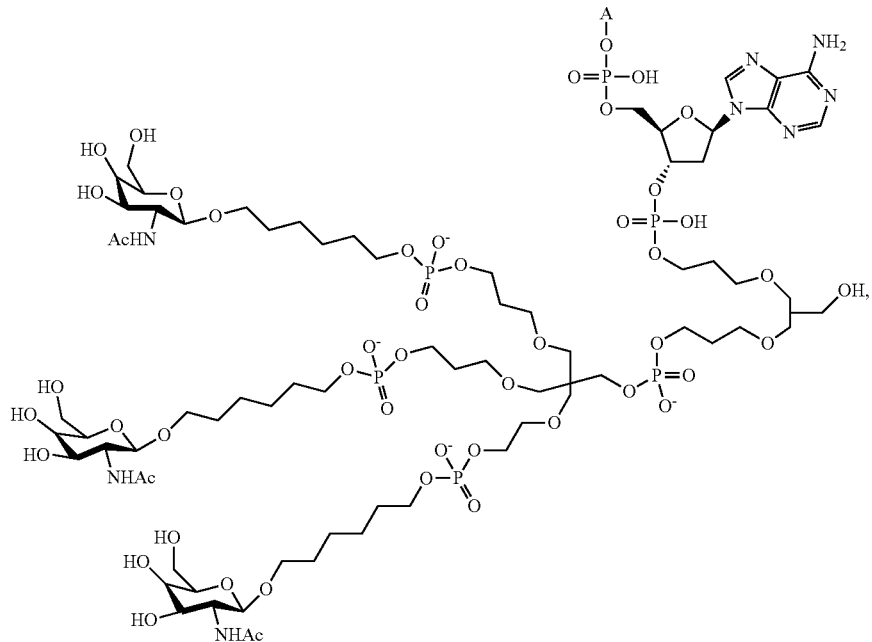
and
wherein A is the antisense oligonucleotide.
Embodiment 905
The conjugated antisense compound of any of embodiments 779 to 789, wherein the conjugate group has the following structure:
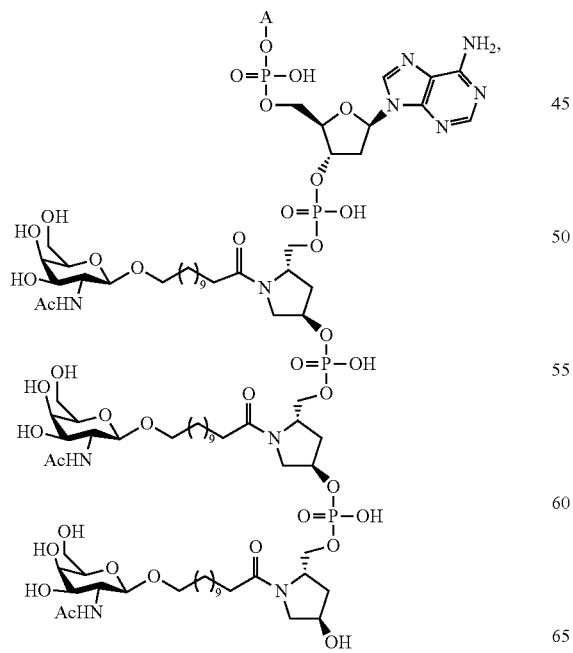
and wherein A is the antisense oligonucleotide.

Embodiment 906

The conjugated antisense compound of any of embodiments 779 to 789, wherein the conjugate group has the following structure:

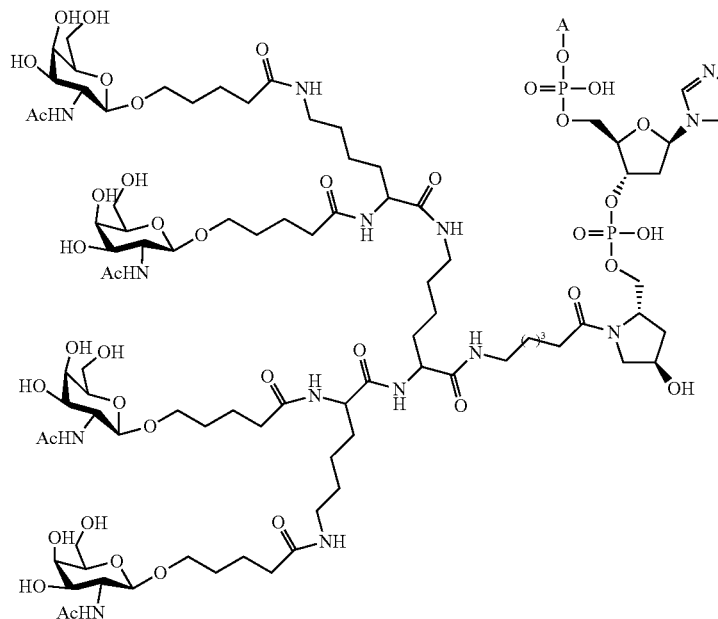

and wherein A is the antisense oligonucleotide.

Embodiment 907

A conjugated oligonucleotide comprising an oligonucleotide and a conjugate group, wherein the conjugate group is any conjugate group of any of embodiments 779 to 907.

Embodiment 908

The conjugated oligonucleotide of embodiment 907 wherein the oligonucleotide comprises at least one modified nucleoside.

Embodiment 909

The conjugated oligonucleotide of embodiment 908 wherein the at least one modified nucleoside comprises a modified base.

Embodiment 910

The conjugated oligonucleotide of embodiment 908 or 909 wherein the at least one modified nucleoside comprises a sugar surrogate.

Embodiment 911

The conjugated oligonucleotide of embodiment 910 wherein the sugar surrogate is a tetrahydropyran.

Embodiment 912

The conjugated oligonucleotide of any of embodiment 911 wherein the tetrahydropyran is F-HNA.

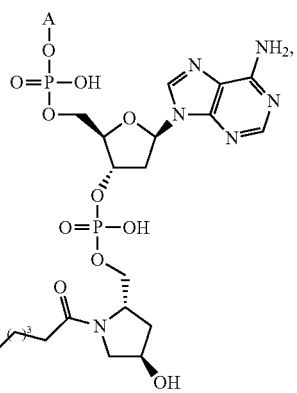

Embodiment 913

The conjugated oligonucleotide of any of embodiments 908 to 912 wherein the remainder of the oligonucleotide comprises at least one nucleoside comprising a modified sugar.

Embodiment 914

The conjugated oligonucleotide of embodiment 913 wherein the at least one modified nucleoside comprising a modified sugar is selected from a bicyclic nucleoside and a 2'-modified nucleoside.

Embodiment 915

The conjugated oligonucleotide of embodiment 914 wherein the at least one modified nucleoside is a bicyclic nucleoside.

Embodiment 916

The conjugated oligonucleotide of embodiment 915 wherein the bicyclic nucleoside is a (4'-$CH_2$—O-2') BNA nucleoside.

Embodiment 917

The conjugated oligonucleotide of embodiment 915 wherein the bicyclic nucleoside is a (4'-$(CH_2)_2$—O-2') BNA nucleoside.

Embodiment 918

The conjugated oligonucleotide of embodiment 915 wherein the bicyclic nucleoside is a (4'-$C(CH_3)H$—O-2') BNA nucleoside.

Embodiment 919

The conjugated oligonucleotide of embodiment 914 wherein the at least one modified nucleoside is a 2'-modified nucleoside.

Embodiment 920

The conjugated oligonucleotide of embodiment 919 wherein the at least one 2'-modified nucleoside is selected from a 2'-F nucleoside, a 2'-OCH$_3$ nucleoside, and a 2'-O(CH$_2$)$_2$OCH$_3$ nucleoside.

Embodiment 921

The conjugated oligonucleotide of embodiment 920 wherein the at least one 2'-modified nucleoside is a 2'-F nucleoside.

Embodiment 922

The conjugated oligonucleotide of embodiment 920 wherein the at least one 2'-modified nucleoside is a 2'-OCH$_3$ nucleoside.

Embodiment 923

The conjugated oligonucleotide of embodiment 920 wherein the at least one 2'-modified nucleoside is a 2'-O(CH$_2$)$_2$OCH$_3$ nucleoside.

Embodiment 924

The conjugated oligonucleotide of any of embodiments 907-923 wherein the oligonucleotide comprises at least one unmodified nucleoside.

Embodiment 925

The conjugated oligonucleotide of embodiment 924 wherein the unmodified nucleoside is a ribonucleoside.

Embodiment 926

The conjugated oligonucleotide of embodiment 924 wherein the unmodified nucleoside is a deoxyribonucleoside.

Embodiment 927

The conjugated oligonucleotide of any of embodiments 907 to 926 wherein the oligonucleotide comprises at least two modified nucleosides.

Embodiment 928

The conjugated oligonucleotide of embodiment 927 wherein the at least two modified nucleosides comprise the same modification.

Embodiment 929

The conjugated oligonucleotide of embodiment 927 wherein the at least two modified nucleosides comprise different modifications.

Embodiment 930

The conjugated oligonucleotide of any of embodiments 927 to 929 wherein at least one of the at least two modified nucleosides comprises a sugar surrogate.

Embodiment 931

The conjugated oligonucleotide of any of embodiments 927 to 930 wherein at least one of the at least two modified nucleosides comprises a 2'-modification.

Embodiment 932

The conjugated oligonucleotide of embodiment 931 wherein each of the at least two modified nucleosides is independently selected from 2'-F nucleosides, 2'-OCH$_3$ nucleosides and 2'-O(CH$_2$)$_2$OCH$_3$ nucleosides.

Embodiment 933

The conjugated oligonucleotide of embodiment 932 wherein each of the at least two modified nucleosides is a 2'-F nucleoside.

Embodiment 934

The conjugated oligonucleotide of embodiment 932 wherein each of the at least two modified nucleosides is a 2'-OCH$_3$ nucleosides.

Embodiment 935

The conjugated oligonucleotide of embodiment 932 wherein each of the at least two modified nucleosides is a 2'-O(CH$_2$)$_2$OCH$_3$ nucleoside.

Embodiment 936

The conjugated oligonucleotide of any of embodiments 907 to 935 wherein essentially every nucleoside of the oligonucleotide is a modified nucleoside.

Embodiment 937

The conjugated oligonucleotide of any of embodiments 907 to 927 or 930 to 936 wherein every nucleoside of the oligonucleotide is a modified nucleoside.

Embodiment 938

The conjugated oligonucleotide of any of embodiments 907 to 937 wherein the oligonucleotide is single-stranded.

Embodiment 939

The conjugated oligonucleotide of any of embodiments 907 to 937 wherein the oligonucleotide is double-stranded.

Embodiment 940

The conjugated oligonucleotide of any of embodiments 907 to 937, wherein the oligonucleotide is an antisense compound.

Embodiment 941

The conjugated oligonucleotide of any of embodiments 907 to 937, wherein the oligonucleotide is a RISC based oligonucleotide.

Embodiment 942

The conjugated oligonucleotide of any of embodiments 907 to 937, wherein the oligonucleotide activates the RISC pathway.

Embodiment 943

The conjugated oligonucleotide of any of embodiments 907 to 937, wherein the oligonucleotide is an RNase H based antisense compound.

Embodiment 944

The conjugated oligonucleotide compound of any of embodiments 907 to 943, wherein the conjugate group is attached to the 5'-terminal nucleoside of the antisense oligonucleotide.

Embodiment 945

The conjugated oligonucleotide compound of any of embodiments 907 to 943, wherein the conjugate group is attached to the 3'-terminal nucleoside of the antisense oligonucleotide.

Embodiment 946

The conjugated oligonucleotide compound of any of embodiments 907 to 943, wherein the conjugate group is attached to an internal nucleoside of the antisense oligonucleotide.

Embodiment 947

The conjugated oligonucleotide compound of any of embodiments 907 to 943, wherein the conjugate group increases uptake of the conjugated oligonucleotide compound into a hepatocyte relative to an unconjugated oligonucleotide compound.

Embodiment 948

The conjugated oligonucleotide compound of any of embodiments 907 to 943, wherein the conjugate group increases the uptake of the conjugated oligonucleotide compound into a liver cell relative to an unconjugated oligonucleotide compound.

Embodiment 949

The conjugated oligonucleotide compound of any of embodiments 907 to 943, wherein the conjugate group increases accumulation of the conjugated oligonucleotide compound in the liver relative to an unconjugated oligonucleotide compound.

Embodiment 950

The conjugated oligonucleotide compound of any of embodiments 907 to 943, wherein the conjugate group decreases accumulation of the conjugated oligonucleotide compound in the kidneys relative to an unconjugated oligonucleotide compound.

Embodiment 951

The conjugated oligonucleotide compound of embodiment 907 to 935 or 938 to 950, wherein the conjugated oligonucleotide has a sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 952

The conjugated oligonucleotide compound of embodiment 951, wherein the 5'-region consists of 2 linked 5'-region nucleosides.

Embodiment 953

The conjugated oligonucleotide compound of embodiment 951, wherein the 5'-region consists of 3 linked 5'-region nucleosides.

Embodiment 954

The conjugated oligonucleotide compound of embodiment 951, wherein the 5'-region consists of 4 linked 5'-region nucleosides.

Embodiment 955

The conjugated oligonucleotide compound of embodiment 951, wherein the 5'-region consists of 5 linked 5'-region nucleosides.

Embodiment 956

The conjugated oligonucleotide compound of any of embodiments 951-955, wherein the 3'-region consists of 2 linked 3'-region nucleosides.

Embodiment 957

The conjugated oligonucleotide compound of any of embodiments 951-955, wherein the 3'-region consists of 3 linked 3'-region nucleosides.

Embodiment 958

The conjugated oligonucleotide compound of any of embodiments 951-955, wherein the 3'-region consists of 4 linked 3'-region nucleosides.

Embodiment 959

The conjugated oligonucleotide compound of any of embodiments 951-955, wherein the 3'-region consists of 5 linked 3'-region nucleosides.

Embodiment 960

The conjugated oligonucleotide compound of any of embodiments 951-959, wherein the central region consists of 5 linked central region nucleosides.

Embodiment 961

The conjugated oligonucleotide compound of any of embodiments 951-959, wherein the central region consists of 6 linked central region nucleosides.

Embodiment 962

The conjugated oligonucleotide compound of any of embodiments 951-959, wherein the central region consists of 7 linked central region nucleosides.

Embodiment 963

The conjugated oligonucleotide compound of any of embodiments 951-959, wherein the central region consists of 8 linked central region nucleosides.

Embodiment 964

The conjugated oligonucleotide compound of any of embodiments 951-959, wherein the central region consists of 9 linked central region nucleosides.

Embodiment 965

The conjugated oligonucleotide compound of any of embodiments 951-959, wherein the central region consists of 10 linked central region nucleosides.

Embodiment 966

The conjugated oligonucleotide compound of any of embodiments 951-965, wherein the conjugated oligonucleotide consists of 14 to 26 linked nucleosides.

Embodiment 967

The conjugated oligonucleotide compound of any of embodiments 951-965, wherein the conjugated oligonucleotide consists of 15 to 25 linked nucleosides.

Embodiment 968

The conjugated oligonucleotide compound of any of embodiments 951-965, wherein the conjugated oligonucleotide consists of 16 to 20 linked nucleosides.

Embodiment 969

The conjugated oligonucleotide compound of any of embodiments 951-968, wherein each modified nucleoside independently comprises a 2'-substituted sugar moiety or a bicyclic sugar moiety.

Embodiment 970

The conjugated oligonucleotide compound of embodiment 969, wherein the at least one modified nucleoside comprises a 2'-substituted sugar moiety.

Embodiment 971

The conjugated oligonucleotide compound of embodiment 970, wherein each modified nucleoside comprising a 2'-substituted sugar moiety comprises a 2' substituent independently selected from among: halogen, optionally substituted allyl, optionally substituted amino, azido, optionally substituted SH, CN, OCN, CF3, OCF3, O, S, or N(Rm)-alkyl; O, S, or N(Rm)-alkenyl; O, S or N(Rm)-alkynyl; optionally substituted O-alkylenyl-O-alkyl, optionally substituted alkynyl, optionally substituted alkaryl, optionally substituted aralkyl, optionally substituted O-alkaryl, optionally substituted O-aralkyl, O(CH2)2SCH3, O—(CH2)2-O—N(Rm)(Rn) or O—CH2-C(=O)—N(Rm)(Rn), where each Rm and Rn is, independently, H, an amino protecting group or substituted or unsubstituted $C_1$-$C_{10}$ alkyl;

wherein each optionally substituted group is optionally substituted with a substituent group independently selected from among: hydroxyl, amino, alkoxy, carboxy, benzyl, phenyl, nitro ($NO_2$), thiol, thioalkoxy (S-alkyl), halogen, alkyl, aryl, alkenyl and alkynyl.

Embodiment 972

The conjugated oligonucleotide compound of embodiment 970, wherein each 2' substituent is independently selected from among: a halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—$CH$=$CH_2$, $O(CH_2)_2$—$OCH_3$, $O(CH_2)_2$—$SCH_3$, $O(CH_2)_2$—$OCF_3$, $O(CH_2)_3$—$N(R_1)(R_2)$, $O(CH_2)_2$—$ON(R_1)(R_2)$, $O(CH_2)_2$—$O(CH_2)_2$—$N(R_1)(R_2)$, $OCH_2C(=O)$—$N(R_1)(R_2)$, $OCH_2C(=O)$—$N(R_3)$—$(CH_2)_2$—$N(R_1)(R_2)$, and $O(CH_2)_2$—$N(R_3)$—$C(=NR_4)[N(R_1)(R_2)]$; wherein $R_1$, $R_2$, $R_3$ and $R_4$ are each, independently, H or $C_1$-$C_6$ alkyl.

Embodiment 973

The conjugated oligonucleotide compound of embodiment 970, wherein each 2' substituent is independently selected from among: a halogen, $OCH_3$, $OCF_3$, $OCH_2CH_3$, $OCH_2CF_3$, $OCH_2$—$CH$=$CH_2$, $O(CH_2)_2$—$OCH_3$ (MOE), $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$.

Embodiment 974

The conjugated oligonucleotide compound of embodiment 970, wherein the at least one 2'-modified nucleoside comprises a 2'-MOE sugar moiety.

Embodiment 975

The conjugated oligonucleotide compound of embodiment 970, wherein the at least one 2'-modified nucleoside comprises a 2'-OMe sugar moiety.

Embodiment 976

The conjugated oligonucleotide compound of embodiment 970, wherein the at least one 2'-modified nucleoside comprises a 2'-F sugar moiety.

Embodiment 977

The conjugated oligonucleotide compound of any of embodiments 951-968, wherein the conjugated oligonucleotide comprises at least one modified nucleoside comprising a sugar surrogate.

Embodiment 978

The conjugated oligonucleotide compound of embodiment 977, wherein the modified nucleoside comprises an F-HNA sugar moiety.

Embodiment 979

The conjugated oligonucleotide compound of embodiment 977, wherein the modified nucleoside comprises an HNA sugar moiety.

Embodiment 980

The conjugated oligonucleotide compound of any of embodiments 951-968 wherein the conjugated oligonucleotide comprises at least one modified nucleoside comprising a bicyclic sugar moiety.

Embodiment 981

The conjugated oligonucleotide compound of embodiment 980, wherein the bicyclic sugar moiety is a cEt sugar moiety.

Embodiment 982

The conjugated oligonucleotide compound of embodiment 980, wherein bicyclic sugar moiety is an LNA sugar moiety.

Embodiment 983

The conjugated oligonucleotide compound of any of embodiments 907 to 982, wherein the conjugated oligonucleotide comprises at least one modified internucleoside linkage.

Embodiment 984

The conjugated oligonucleotide compound of embodiment 908, wherein each internucleoside linkage of the conjugated oligonucleotide is a modified internucleoside linkage.

Embodiment 985

The conjugated oligonucleotide compound of embodiment 983, wherein the conjugated oligonucleotide comprises at least one modified linkage and at least one unmodified phosphodiester internucleoside linkage.

Embodiment 986

The conjugated oligonucleotide compound of any of embodiments 983 to 985 wherein at least one modified internucleoside linkage is a phosphosphorothioate internucleoside linkage.

Embodiment 987

The conjugated oligonucleotide compound of any of embodiments 983 to 985, wherein each modified internucleoside linkage is a phosphorothioate internucleoside linkage.

Embodiment 988

The conjugated oligonucleotide compound of any of embodiments 983 to 984, wherein the conjugated oligonucleotide comprises at least 2 phosphodiester internucleoside linkages.

Embodiment 989

The conjugated oligonucleotide compound of any of embodiments 983 to 984, wherein the conjugated oligonucleotide comprises at least 3 phosphodiester internucleoside linkages.

Embodiment 990

The conjugated oligonucleotide compound of any of embodiments 983 to 984, wherein the conjugated oligonucleotide comprises at least 4 phosphodiester internucleoside linkages.

Embodiment 991

The conjugated oligonucleotide compound of any of embodiments 983 to 984, wherein the conjugated oligonucleotide comprises at least 5 phosphodiester internucleoside linkages.

Embodiment 992

The conjugated oligonucleotide compound of any of embodiments 983 to 984, wherein the conjugated oligonucleotide comprises at least 6 phosphodiester internucleoside linkages.

Embodiment 993

The conjugated oligonucleotide compound of any of embodiments 983 to 984, wherein the conjugated oligonucleotide comprises at least 7 phosphodiester internucleoside linkages.

Embodiment 994

The conjugated oligonucleotide compound of any of embodiments 983 to 984, wherein the conjugated oligonucleotide comprises at least 8 phosphodiester internucleoside linkages.

Embodiment 995

The conjugated oligonucleotide compound of any of embodiments 983 to 984, wherein the conjugated oligonucleotide comprises at least 9 phosphodiester internucleoside linkages.

Embodiment 996

The conjugated oligonucleotide compound of any of embodiments 983 to 984, wherein the conjugated oligonucleotide comprises at least 10 phosphodiester internucleoside linkages.

Embodiment 997

The conjugated oligonucleotide compound of any of embodiments 983 or 985 to 996, wherein the conjugated oligonucleotide comprises fewer than 16 phosphorothioate internucleoside linkages.

Embodiment 998

The conjugated oligonucleotide compound of any of embodiments 983 or 985 to 996, wherein the conjugated oligonucleotide comprises fewer than 15 phosphorothioate internucleoside linkages.

Embodiment 999

The conjugated oligonucleotide compound of any of embodiments 983 or 985 to 996, wherein the conjugated oligonucleotide comprises fewer than 14 phosphorothioate internucleoside linkages.

Embodiment 1000

The conjugated oligonucleotide compound of any of embodiments 983 or 985 to 996, wherein the conjugated oligonucleotide comprises fewer than 13 phosphorothioate internucleoside linkages.

Embodiment 1001

The conjugated oligonucleotide compound of any of embodiments 983 or 985 to 996, wherein the conjugated oligonucleotide comprises fewer than 12 phosphorothioate internucleoside linkages.

Embodiment 1002

The conjugated oligonucleotide compound of any of embodiments 983 or 985 to 996, wherein the conjugated oligonucleotide comprises fewer than 11 phosphorothioate internucleoside linkages.

Embodiment 1003

The conjugated oligonucleotide compound of any of embodiments 983 or 985 to 996, wherein the conjugated oligonucleotide comprises fewer than 10 phosphorothioate internucleoside linkages.

Embodiment 1004

The conjugated oligonucleotide compound of any of embodiments 983 or 985 to 996, wherein the conjugated oligonucleotide comprises fewer than 9 phosphorothioate internucleoside linkages.

Embodiment 1005

The conjugated oligonucleotide compound of any of embodiments 983 or 985 to 996, wherein the conjugated oligonucleotide comprises fewer than 8 phosphorothioate internucleoside linkages.

Embodiment 1006

The conjugated oligonucleotide compound of any of embodiments 983 or 985 to 996, wherein the conjugated oligonucleotide comprises fewer than 7 phosphorothioate internucleoside linkages.

Embodiment 1007

The conjugated oligonucleotide compound of any of embodiments 983 or 985 to 996, wherein the conjugated oligonucleotide comprises fewer than 6 phosphorothioate internucleoside linkages.

Embodiment 1008

The conjugated oligonucleotide compound of any of embodiments 907 to 1007, wherein each terminal internucleoside linkage of the conjugated oligonucleotide is a phosphorothioate internucleoside linkage.

Embodiment 1009

The conjugated oligonucleotide compound of any of embodiments 907 to 984 or 997 to 1008, wherein each internucleoside linkage linking two deoxynucleosides of the conjugated oligonucleotide is a phosphorothioate internucleoside linkage.

Embodiment 1010

The conjugated oligonucleotide compound of any of embodiments 907 to 984 or 997 to 1009, wherein each non-terminal internucleoside linkage linking two modified nucleosides of the conjugated oligonucleotide is a phosphodiester internucleoside linkage.

Embodiment 1011

The conjugated oligonucleotide compound of any of embodiments 907 to 984 or 997 to 1010, wherein each non-terminal internucleoside linkage of the conjugated oligonucleotide that is 3' of a modified nucleoside is a phosphodiester internucleoside linkage.

Embodiment 1012

The conjugated oligonucleotide compound of any of embodiments 907 to 984 or 997 to 1011, wherein each internucleoside linkage of the conjugated oligonucleotide that is 3' of a deoxynucleoside is a phosphorothioate internucleoside linkage.

Embodiment 1013

The conjugated oligonucleotide compound of any of embodiments 907 to 984 or 997 to 1012 wherein the conjugated oligonucleotide has a chemical motif selected from among:

MsMy(Ds)$_{0-1}$(DsDs)$_{(3-5)}$MsM
MsMy(Ds)$_{0-1}$(DsDs)$_{(3-5)}$MyMsM
MsMy(Ds)$_{0-1}$(DsDs)$_{(3-5)}$MyMyMsM
MsMy(Ds)$_{0-1}$(DsDs)$_{(3-5)}$MyMyMyMsM
MsMyMy(Ds)$_{0-1}$(DsDs)$_{(3-5)}$MsM
MsMyMy(Ds)$_{0-1}$(DsDs)$_{(3-5)}$MyMsM
MsMyMy(Ds)$_{0-1}$(DsDs)$_{(3-5)}$MyMyMsM
MsMyMy(Ds)$_{0-1}$(DsDs)$_{(3-5)}$MyMyMyMsM
MsMyMyMy(Ds)$_{0-1}$(DsDs)$_{(3-5)}$MsM
MsMyMyMy(Ds)$_{0-1}$(DsDs)$_{(3-5)}$MyMsM
MsMyMyMy(Ds)$_{0-1}$(DsDs)$_{(3-5)}$MyMyMsM
MsMyMyMy(Ds)$_{0-1}$(DsDs)$_{(3-5)}$MyMyMyMsM
MsMyMyMyMy(Ds)$_{0-1}$(DsDs)$_{(3-5)}$MsM
MsMyMyMyMy(Ds)$_{0-1}$(DsDs)$_{(3-5)}$MyMsM
MsMyMyMyMy(Ds)$_{0-1}$(DsDs)$_{(3-5)}$MyMyMsM; and
MsMyMyMyMy(Ds)$_{0-1}$(DsDs)$_{(3-5)}$MyMyMyMsM;
wherein each M is independently a modified nucleoside, each D is a deoxynucleoside; each s is a phosphorothioate internucleoside linkage, and each y is either a phosphodiester internucleoside linkage or a phosphorothioate internucleoside linkage, provided that at least one y is a phosphodiester internucleotide linkage.

Embodiment 1014

The conjugated oligonucleotide compound of any of embodiments 907 to 984 or 997 to 1012, wherein the conjugated oligonucleotides has a chemical motif selected from among:
MsMo(Ds)$_{0-1}$(DsDs)$_{(3-5)}$MoMsM
MsMo(Ds)$_{0-1}$(DsDs)$_{(3-5)}$MoMoMsM
MsMo(Ds)$_{0-1}$(DsDs)$_{(3-5)}$MoMoMoMsM
MsMoMo(Ds)$_{0-1}$(DsDs)$_{(3-5)}$MsM
MsMoMo(Ds)$_{0-1}$(DsDs)$_{(3-5)}$MoMsM
MsMoMo(Ds)$_{0-1}$(DsDs)$_{(3-5)}$MoMoMsM
MsMoMo(Ds)$_{0-1}$(DsDs)$_{(3-5)}$MoMoMoMsM
MsMoMoMo(Ds)$_{0-1}$(DsDs)$_{(3-5)}$MsM
MsMoMoMo(Ds)$_{0-1}$(DsDs)$_{(3-5)}$MoMsM
MsMoMoMo(Ds)$_{0-1}$(DsDs)$_{(3-5)}$MoMoMsM
MsMoMoMo(Ds)$_{0-1}$(DsDs)$_{(3-5)}$MoMoMoMsM
MsMoMoMoMo(Ds)$_{0-1}$(DsDs)$_{(3-5)}$MsM
MsMoMoMoMo(Ds)$_{0-1}$(DsDs)$_{(3-5)}$MoMsM
MsMoMoMoMo(Ds)$_{0-1}$(DsDs)$_{(3-5)}$MoMoMsM; and
MsMoMoMoMo(Ds)$_{0-1}$(DsDs)$_{(3-5)}$MoMoMoMsM;
wherein each M is independently a modified nucleoside, each D is a deoxynucleoside; each o is a phosphodiester internucleoside linkage, and each s is a phosphorothioate internucleoside linkage.

Embodiment 1015

The conjugated oligonucleotide compound of embodiment 1013 or 1014, wherein each M is independently selected from among: a 2'-MOE nucleoside and a bicyclic nucleoside.

Embodiment 1016

The conjugated oligonucleotide compound of embodiment 1015, wherein each M is independently selected from among a 2'-MOE nucleoside, a cEt nucleoside, and an LNA nucleoside.

Embodiment 1017

The conjugated oligonucleotide compound of embodiment 1015 or 1016, wherein each M is a 2'-MOE nucleoside.

Embodiment 1018

The conjugated oligonucleotide compound of embodiment 1015 or 1016, wherein each M is a cEt nucleoside.

Embodiment 1019

The conjugated oligonucleotide compound of embodiments 1015 or 1016, wherein each M is an LNA nucleoside.

Embodiment 1020

The conjugated oligonucleotide compound of any of embodiments 907 to 1019, wherein the conjugated oligonucleotide has a nucleobase sequence comprising an at least 8 nucleobase portion complementary to an equal length portion of a target nucleic acid.

Embodiment 1021

The conjugated oligonucleotide compound of any of embodiments 907 to 1019, wherein the conjugated oligonucleotide has a nucleobase sequence comprising an at least 10 nucleobase portion complementary to an equal length portion of a target nucleic acid.

Embodiment 1022

The conjugated oligonucleotide compound of any of embodiments 907 to 1019, wherein the conjugated oligonucleotide has a nucleobase sequence comprising an at least 12 nucleobase portion complementary to an equal length portion of a target nucleic acid.

Embodiment 1023

The conjugated oligonucleotide compound of any of embodiments 907 to 1019, wherein the conjugated oligonucleotide has a nucleobase sequence comprising an at least 14 nucleobase portion complementary to an equal length portion of a target nucleic acid.

Embodiment 1024

The conjugated oligonucleotide compound of any of embodiments 907 to 1019, wherein the conjugated oligonucleotide has a nucleobase sequence comprising an at least 16 nucleobase portion complementary to an equal length portion of a target nucleic acid.

Embodiment 1025

The conjugated oligonucleotide compound of any of embodiments 907 to 1019, wherein the conjugated oligonucleotide has a nucleobase sequence comprising an at least 18 nucleobase portion complementary to an equal length portion of a target nucleic acid.

Embodiment 1026

The conjugated oligonucleotide compound of any of embodiments 907 to 1019, wherein the conjugated oligonucleotide is at least 90% complementary to a target nucleic acid.

Embodiment 1027

The conjugated oligonucleotide compound of any of embodiments 907 to 1019, wherein the conjugated oligonucleotide is at least 95% complementary to a target nucleic acid.

Embodiment 1028

The conjugated oligonucleotide compound of any of embodiments 907 to 1019, wherein the conjugated oligonucleotide is 100% complementary to a target nucleic acid.

Embodiment 1029

The conjugated oligonucleotide compound of any of embodiments 1020 to 1028, wherein the target nucleic acid is a pre-mRNA.

Embodiment 1030

The conjugated oligonucleotide compound of any of embodiments 1020 to 1028, wherein the target nucleic acid is an mRNA.

Embodiment 1031

The conjugated oligonucleotide compound of any of embodiments 1020 to 1030, wherein the target nucleic acid is a micro RNA.

Embodiment 1032

The conjugated oligonucleotide compound of any of embodiments 1020 to 1030, wherein the target nucleic acid is expressed in the liver.

Embodiment 1033

The conjugated oligonucleotide compound of any of embodiments 1020 to 1030, wherein the target nucleic acid is expressed in hepatocytes.

Embodiment 1034

The conjugated oligonucleotide compound of any of embodiments 1020 to 1030, wherein the target nucleic acid encodes a protein selected from among: Androgen Receptor, Apolipoprotein (a), Apolipoprotein B, Apolipoprotein C-III, C-Reactive Protein, eIF-4E, Factor VII, Factor XI, Glucocorticoid Receptor, Glucagon Receptor, Protein Tyrosine Phosphatase 1B, STAT3, SRB-1, and Transthyretin.

Embodiment 1035

The conjugated oligonucleotide compound of any of embodiments 1020 to 1031 wherein the target nucleic acid is a viral nucleic acid.

Embodiment 1036

The conjugated oligonucleotide compound of embodiment 1035, wherein the viral nucleic acid expressed in the liver.

Embodiment 1037

The conjugated oligonucleotide compound of embodiment 1036, wherein the target nucleic acid is a Hepatitis B viral nucleic acid.

Embodiment 1038

The conjugated oligonucleotide compound of any of embodiments 907 to 1030, wherein the conjugated oligonucleotide comprises the nucleobase sequence of any one of SEQ ID NOs.: 17, 18, 19, 20, 21, 22, 23, or 24.

Embodiment 1039

The conjugated oligonucleotide compound of any of embodiments 907 to 1030, wherein the conjugated oligonucleotide comprises the nucleobase sequence of any one of SEQ ID NO.: 25, 26, 27, 28, 29, or 30.

Embodiment 1040

The conjugated oligonucleotide compound of any of embodiments 907 to 1030, wherein the conjugated oligonucleotide comprises the nucleobase sequence of SEQ ID NO.: 31.

Embodiment 1041

The conjugated oligonucleotide compound of any of embodiments 907 to 1030, wherein the conjugated oligonucleotide comprises the nucleobase sequence of SEQ ID NO.: 32.

Embodiment 1042

The conjugated oligonucleotide compound of any of embodiments 907 to 1030, wherein the conjugated oligonucleotide comprises the nucleobase sequence of SEQ ID NO.: 33.

Embodiment 1043

The conjugated oligonucleotide compound of any of embodiments 907 to 1030, wherein the conjugated oligonucleotide comprises the nucleobase sequence of SEQ ID NO.: 34.

Embodiment 1044

The conjugated oligonucleotide compound of any of embodiments 907 to 1030, wherein the conjugated oligonucleotide comprises the nucleobase sequence of any of SEQ ID NOs.: 35, 36, 37, 38, 39, 40, 41, 42, or 43.

Embodiment 1045

The conjugated oligonucleotide compound of any of embodiments 907 to 1030, wherein the conjugated oligonucleotide comprises the nucleobase sequence of SEQ ID NO.: 44, 45, 46, 47, or 48.

Embodiment 1046

The conjugated oligonucleotide compound of any of embodiments 907 to 1030, wherein the conjugated oligonucleotide comprises the nucleobase sequence of any of SEQ ID NOs.: 49, 50, 51, 52, 53, 54, 55, 56, 57, 58, or 59.

Embodiment 1047

The conjugated oligonucleotide compound of any of embodiments 907 to 1030, wherein the conjugated oligonucleotide comprises the nucleobase sequence of any of SEQ ID NOs.: 60, 61, 62, 63, 64, 65, 66, or 67.

Embodiment 1048

The conjugated oligonucleotide compound of any of embodiments 907 to 1030, wherein the conjugated oligonucleotide comprises the nucleobase sequence of any of SEQ ID NO.: 69, 70, 71, or 72.

Embodiment 1049

The conjugated oligonucleotide compound of any of embodiments 907 to 1030, wherein the conjugated oligonucleotide comprises the nucleobase sequence of SEQ ID NO.: 73.

Embodiment 1050

The conjugated oligonucleotide compound of any of embodiments 907 to 1030, wherein the conjugated oligonucleotide comprises the nucleobase sequence of any of SEQ ID NOs.: 74, 75, 76, 77, 78, 79, 80, or 81.

Embodiment 1051

The conjugated oligonucleotide compound of any of embodiments 907 to 1030, wherein the conjugated oligonucleotide comprises the nucleobase sequence of SEQ ID NO.: 68.

Embodiment 1052

The conjugated oligonucleotide compound of any of embodiments 907 to 1030, wherein the conjugated oligonucleotide comprises the nucleobase sequence of any of SEQ ID NOs.: 82-103, 111, or 113.

Embodiment 1053

The conjugated oligonucleotide compound of any of embodiments 907 to 1052, wherein the conjugated oligonucleotide is an antisense oligonucleotide.

Embodiment 1054

A pharmaceutical composition comprising a compound or conjugated oligonucleotide according to any of embodiments 779 to 1053 and a pharmaceutically acceptable carrier or diluent.

Embodiment 1055

The pharmaceutical composition of embodiment 1054 wherein the pharmaceutically acceptable carrier or diluent is selected from among sterile water and sterile saline.

Embodiment 1056

A method of reducing the amount or activity of a target nucleic acid in a cell, comprising contacting a cell with a compound or conjugated antisense compound of any of embodiments 779 to 1053, or the pharmaceutical composition of embodiments 1054 to 1055.

Embodiment 1057

The method of embodiment 1056, wherein the cell is a liver cell.

Embodiment 1058

The method of embodiment 1056, wherein the cell is a hepatocyte.

Embodiment 1059

The method of any of embodiments 1056 to 1058 wherein the cell is in vitro.

Embodiment 1060

The method of any of embodiments 1056 to 1058, wherein the cell is in an animal.

Embodiment 1061

The method of embodiment 1060 wherein the animal is a mouse.

Embodiment 1062

The method of embodiment 1060 wherein the animal is a human

Embodiment 1063

A method of treating a disease or condition in an animal comprising administering the pharmaceutical composition of embodiment 1054 or 1056 to the animal and thereby treating the disease or condition in the animal.

Embodiment 1064

The method of embodiment 1063 wherein the animal is a mouse.

Embodiment 1065

The method of embodiment 1063 wherein the animal is a human

Embodiment 1066

The method of any of embodiments 1063 to 1065, wherein the disease or condition is a liver disease or condition.

Embodiment 1067

The method of any of embodiments 1063 to 1065 wherein the administration is parenteral.

Embodiment 1068

The method embodiment 1067 wherein the administration is by subcutaneous injection.

Embodiment 1069

The method of embodiment 1067 wherein the administration is by intravenous injection.

Embodiment 1070

The method of embodiment 1067 wherein the administration is by intramuscular injection.

Embodiment 1071

The method of any of embodiments 741 to 748 wherein the conjugated oligonucleotide is provided at a dose of 1-10 mg/kg.

Embodiment 1072

The method of any of embodiments 1056 to 1070 wherein the conjugated oligonucleotide is provided at a dose of less than 1 mg/kg.

Embodiment 1073

The method of any of embodiments 1056 to 1070 wherein the conjugated oligonucleotide is provided at a dose of greater than 10 mg/kg.

Embodiment 1074

The method of any of embodiments 1056 to 1073 wherein the conjugated oligonucleotide is provided for a dosing period of at least 2 months.

Embodiment 1075

The method of any of embodiments 1056 to 1073 wherein the conjugated oligonucleotide is provided for a dosing period of at least 4 months.

Embodiment 1076

The method of any of embodiments 1056 to 1073 wherein the conjugated oligonucleotide is provided for a dosing period of at least 6 months.

Embodiment 1077

The method of any of embodiments 1056 to 1073 wherein the conjugated oligonucleotide is provided at a dosing frequency of about one dose every week.

Embodiment 1078

The method of any of embodiments 1056 to 1073 wherein the conjugated oligonucleotide is provided at a dosing frequency of about one dose every two weeks.

Embodiment 1079

The method of any of embodiments 1056 to 1073 wherein the conjugated oligonucleotide is provided at a dosing frequency of about one dose every three weeks.

Embodiment 1080

The method of any of embodiments 1056 to 1073 wherein the conjugated oligonucleotide is provided at a dosing frequency of one dose every four weeks.

Embodiment 1081

The method of any of embodiments 1056 to 1073 wherein the conjugated oligonucleotide is provided at a dosing frequency of one dose every five weeks.

Embodiment 1082

The method of any of embodiments 1056 to 1073 wherein the conjugated oligonucleotide is provided at a dosing frequency of one dose every six weeks.

Embodiment 1083

The method of any of embodiments 1056 to 1073 wherein the conjugated oligonucleotide is provided at a dosing frequency of one dose every seven weeks.

Embodiment 1084

The method of any of embodiments 1056 to 1073 wherein the conjugated oligonucleotide is provided at a dosing frequency of one dose every eight weeks.

Embodiment 1085

A conjugated antisense compound comprising: an antisense oligonucleotide comprising 12-30 linked nucleosides, and a conjugate group, wherein the conjugate group comprises at least one cell-targeting moiety.

Embodiment 1086

A method of reducing the activity or amount of an Apolipoprotein C-III protein in a cell, comprising contacting a cell with at least one conjugated antisense compound of any of embodiments 779 to 1055; and thereby reducing the activity or amount of the Apolipoprotein C-III protein in the cell.

Embodiment 1087

A method of decreasing total cholesterol, comprising contacting a cell with at least one compound of any of embodiments 779 to 1055; and thereby decreasing total cholesterol.

Embodiment 1088

A method of decreasing triglycerides, comprising contacting a cell with at least one compound of any of embodiments 779 to 1055; and thereby decreasing triglycerides.

Embodiment 1089

A method of lowering LDL, comprising contacting a cell with at least one compound of any of embodiments 779 to 1055; and thereby lowering LDL.

Embodiment 1090

A method of increasing HDL, comprising contacting a cell with at least one compound of any of embodiments 779 to 1055; and thereby increasing HDL.

Embodiment 1091

The method of any of embodiments 1086 to 1090, wherein the cell is in vitro.

Embodiment 1092

The method of any of embodiments 1086 to 1090, wherein the cell is in an animal.

Embodiment 1093

The method of any of embodiments 1086 to 1090, wherein the animal is a human.

Embodiment 1094

The compound or conjugated oligonucleotide of any of embodiments 1-1055 or a prodrug thereof.

Embodiment 1095

A method of manufacturing an antisense oligonucleotide of any of embodiments 1-1055.

Embodiment 1096

A method of preparing an antisense oligonucleotide of any of embodiments 1-1055.

Embodiment 1097

A process for manufacturing a conjugated antisense compound of any one of embodiments 1-1055, wherein the method includes formulating the conjugated antisense compound for human use, performing chromatogram analysis of the formulated conjugated antisense compound, and packaging the conjugated antisense compound ready for sale.

Embodiment 1098

A conjugate compound comprising at least one phosphorus linking group or neutral linking group and one or more ligands.

Embodiment 1099

The conjugate compound of claim 1098 comprising two or more ligands.

Embodiment 1100

The conjugate compound of claim 1098 comprising three ligands.

Embodiment 1101

The conjugate compound of any of claims 1098 to 1100, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, β-D-Mannofuranose, α-D-Mannopyranose, β-D-Mannopyranose, α-D-Glucopyranose, β-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 1102

The conjugate compound of any of claims 1098 to 1101, wherein the ligand is N-acetyl galactoseamine

Embodiment 1103

The conjugate compound of any of claims 1098 to 1102, wherein conjugate group comprises a structure selected from among:

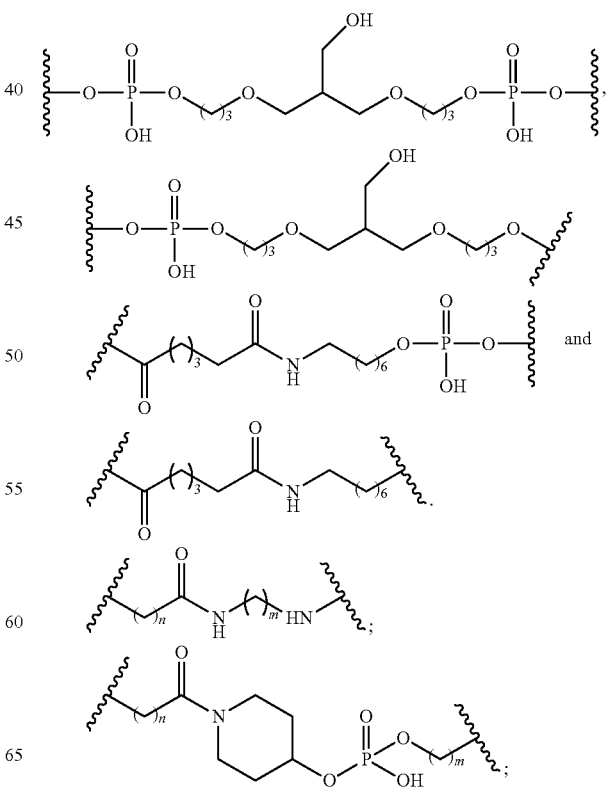

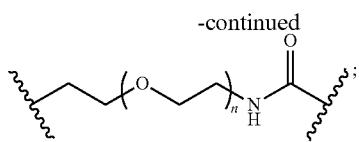

wherein n is from 1 to 12; and
wherein m is from 1 to 12.

Embodiment 1104

The conjugate compound of any of claims 1098 to 1102, wherein the conjugate compound has a tether having a structure selected from among:

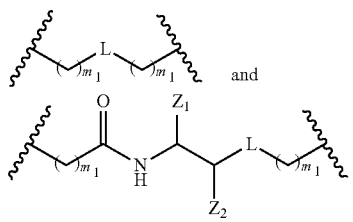

wherein L is either a phosphorus linking group or a neutral linking group;
$Z_1$ is C(=O)O—$R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

Embodiment 1105

The conjugate compound of claim 1104, wherein the tether has a structure selected from among:

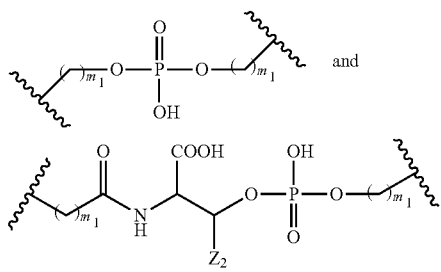

wherein $Z_2$ is H or $CH_3$; and
each $m_1$ is, independently, from 0 to 20 wherein at least one $m_1$ is greater than 0 for each tether.

Embodiment 1106

The conjugate compound of any of claims 1098 to 1102, wherein the tether has a structure selected from among:

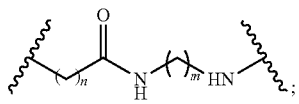

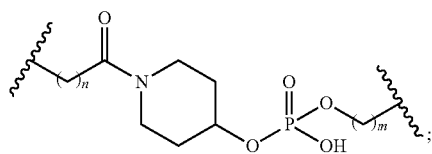

wherein n is from 1 to 12; and
wherein m is from 1 to 12.

Embodiment 1107

The conjugate compound of any of claims 1098 to 1106, wherein the conjugate compound is covalently attached to an oligonucleotide.

Embodiment 1108

An oligomeric compound comprising an oligonucleotide and at least one conjugate group, wherein at least one conjugate group is a conjugate compound of any of claims 1098 to 1108.

Embodiment 1109

A compound having the formula (V):

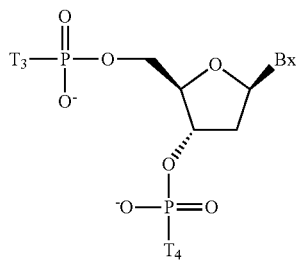

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, or GalNAc$_3$-22a.

and the other of $T_3$ or $T_4$ is selected from among: a hydroxyl, a hydroxyl protecting group, a nucleoside, an oligonucleotide, a monomeric subunit, or an oligomeric compound; and wherein Bx is a heterocyclic base moiety.

Embodiment 1110

A compound having the formula (Va):

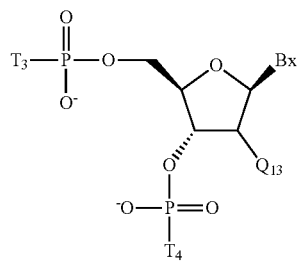

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, or GalNAc$_3$-22a.

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety; and wherein $Q_{13}$ is selected from among: a halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$.

Embodiment 1111

The compound of claim 1109 or 1110, wherein $B_x$ is selected from adenine, guanine, thymine, uracil, or cytosine.

Embodiment 1112

The compound of any of claims 1109 to 1111, wherein $Q_{13}O$—$(CH_2)_2$—$OCH_3$.

Embodiment 1113

A compound having the formula (XVI):

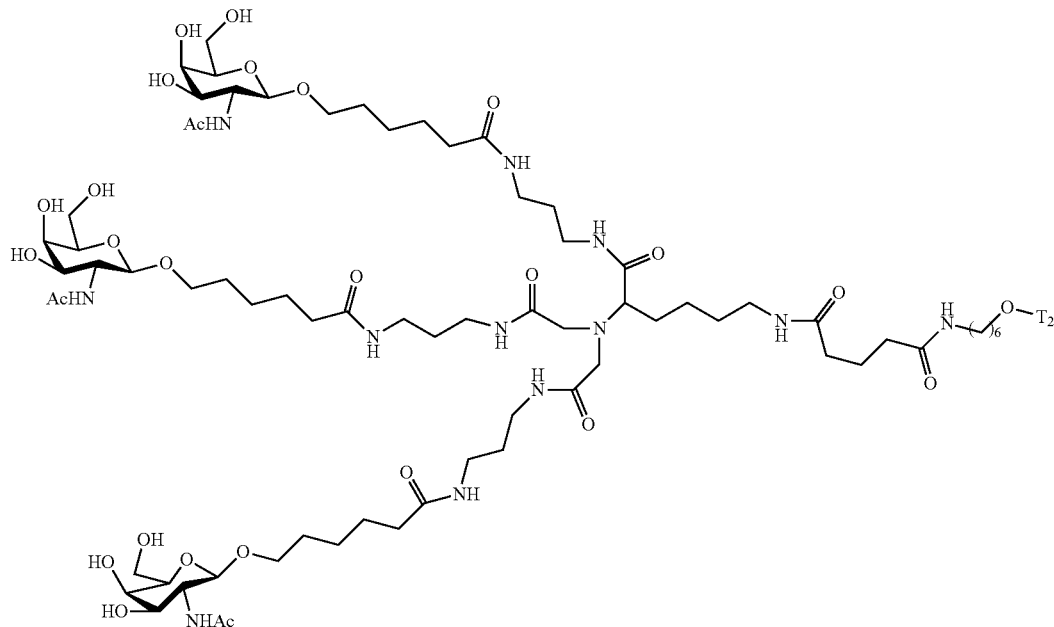

wherein:
$T_2$ is a nucleoside, a nucleotide, a monomeric subunit, or an oligomeric compound.

Embodiment 1114
A compound having the formula (XVII):
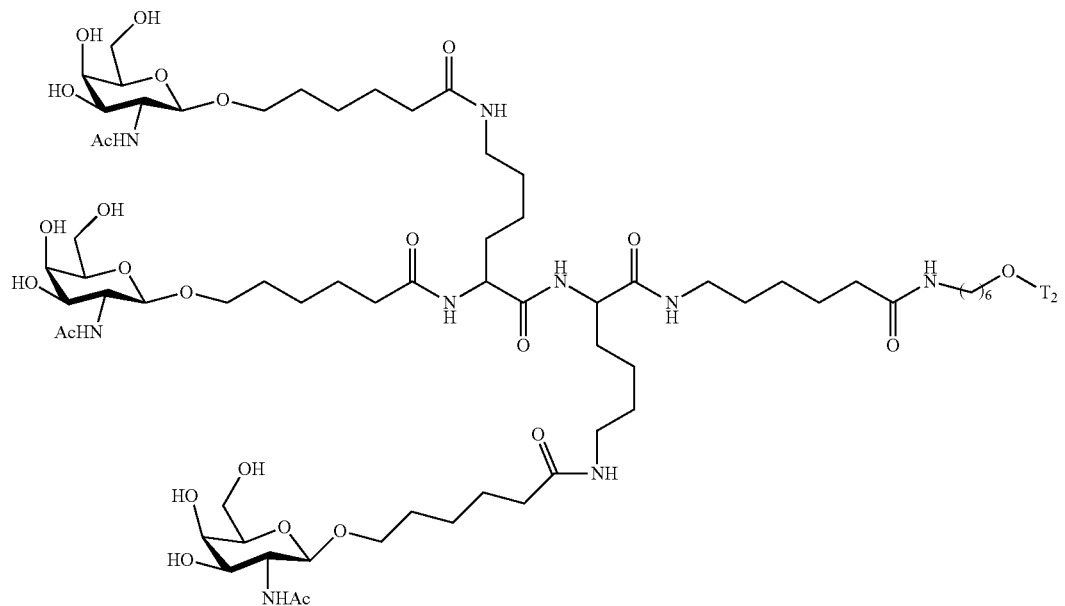
wherein:
T₂ is a nucleoside, a nucleotide, a monomeric subunit, or an oligomeric compound.
Embodiment 1115
A compound having the formula (XVIII):
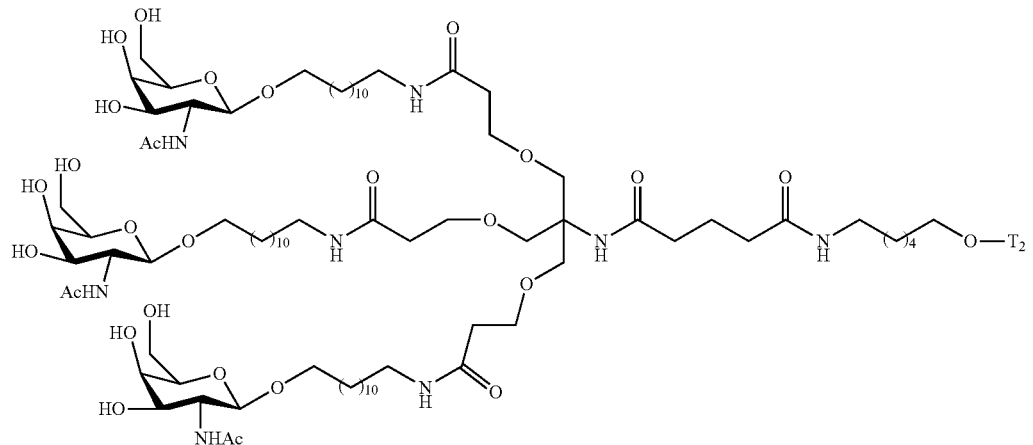
wherein:
T₂ is a nucleoside, a nucleotide, a monomeric subunit, or an oligomeric compound.

Embodiment 1116
A compound having the formula (XIX):
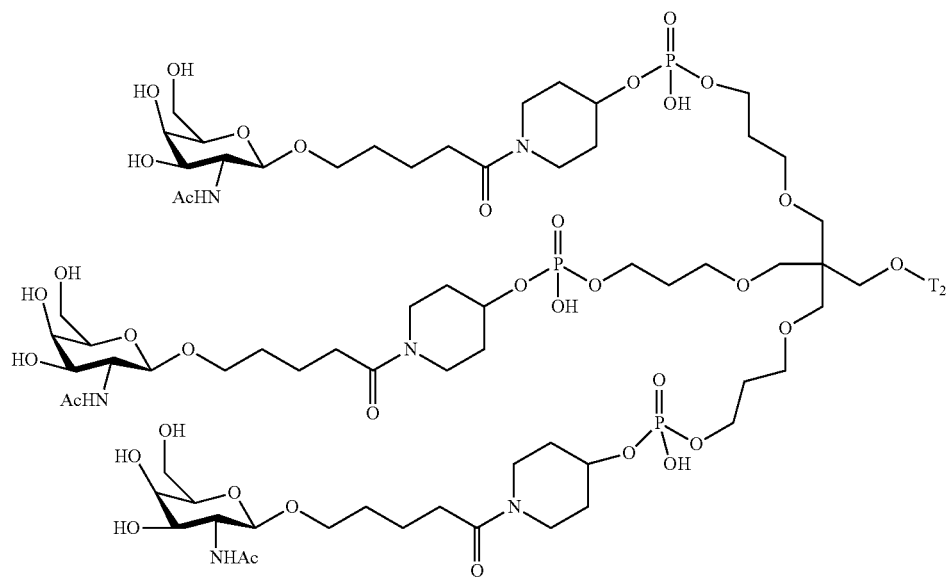
wherein:
$T_2$ is a nucleoside, a nucleotide, a monomeric subunit, or an oligomeric compound.
Embodiment 1117
A compound having the formula (XX):
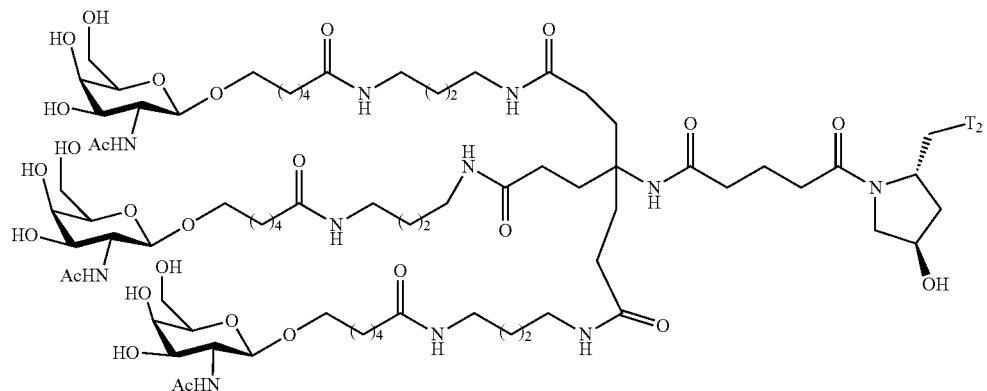
wherein:
$T_2$ is a nucleoside, a nucleotide, a monomeric subunit, or an oligomeric compound.

Embodiment 1118
A compound having the formula (XXI):
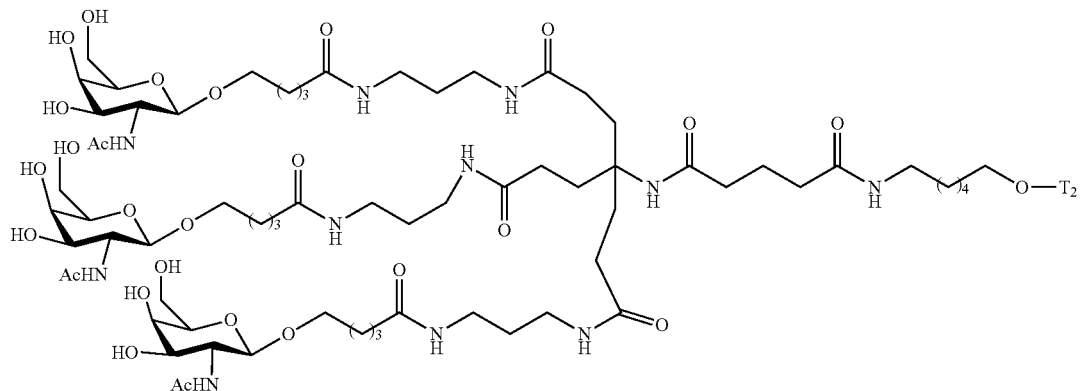
wherein:
$T_2$ is a nucleoside, a nucleotide, a monomeric subunit, or an oligomeric compound.
Embodiment 1119
A compound having the formula (XXII):
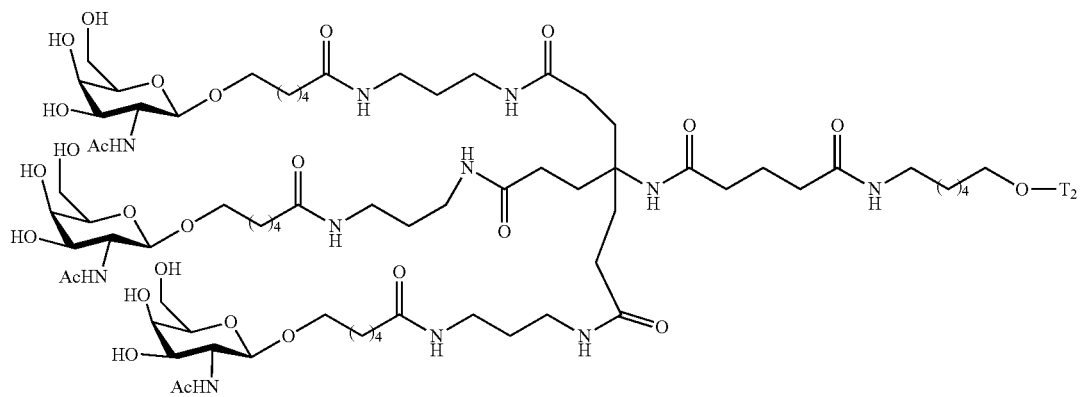
wherein:
$T_2$ is a nucleoside, a nucleotide, a monomeric subunit, or an oligomeric compound.

307

Embodiment 1120

A compound having the formula (XXIII):

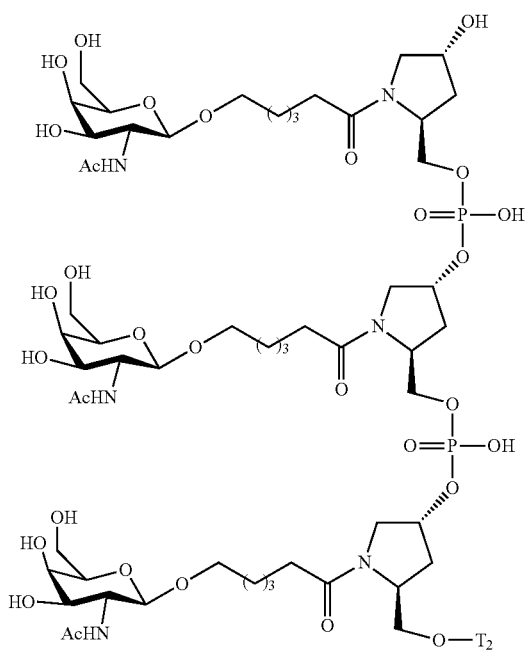

wherein:

T$_2$ is a nucleoside, a nucleotide, a monomeric subunit, or an oligomeric compound.

Embodiment 1121

A compound having the formula (XXIIIa):

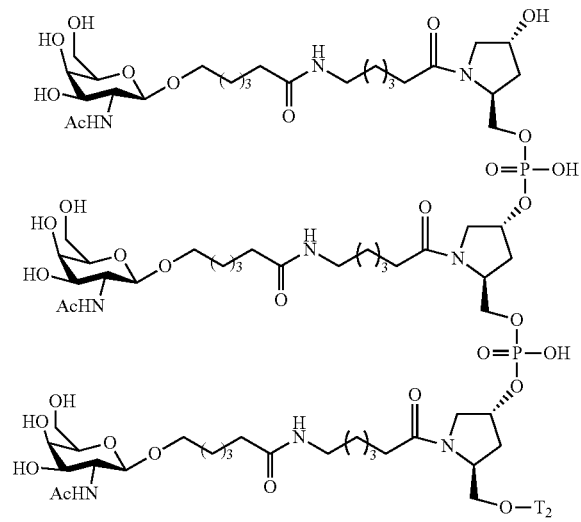

wherein:

T$_2$ is a nucleoside, a nucleotide, a monomeric subunit, or an oligomeric compound.

308

Embodiment 1122

A compound having the formula (XXIV):

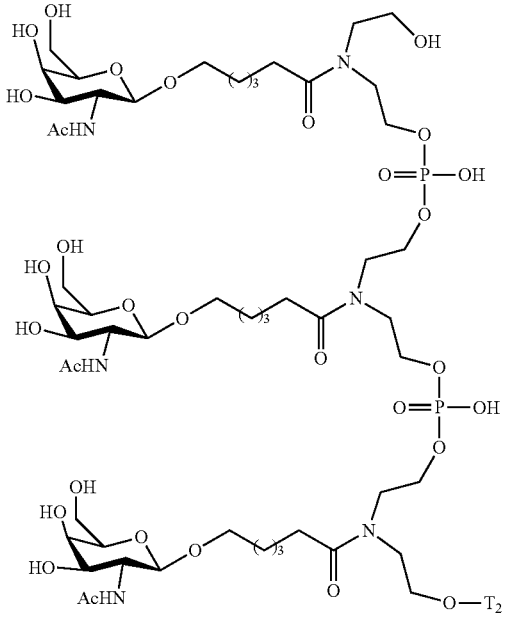

wherein:

T$_2$ is a nucleoside, a nucleotide, a monomeric subunit, or an oligomeric compound.

Embodiment 1123

A compound having the formula (XXIVa):

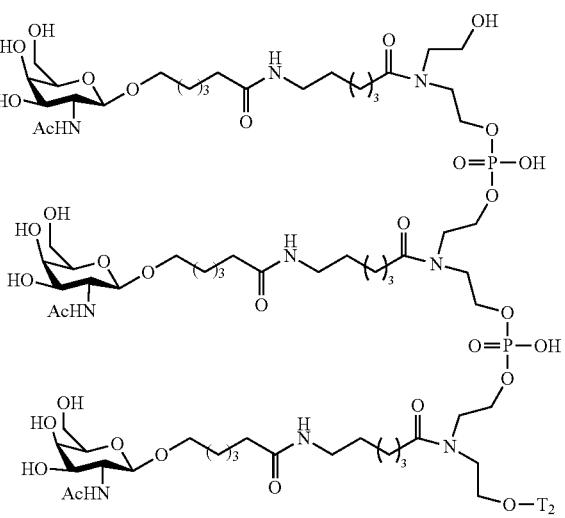

wherein:

T$_2$ is a nucleoside, a nucleotide, a monomeric subunit, or an oligomeric compound.

Embodiment 1124

A conjugated antisense compound, wherein the compound has a structure represented by the formula:

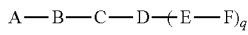

wherein
A is the antisense oligonucleotide;
B is the cleavable moiety
C is the conjugate linker
D is the branching group
each E is a tether;
each F is a ligand; and
q is an integer between 1 and 5.

Embodiment 1125

A conjugated antisense compound, wherein the compound has a structure represented by the formula:

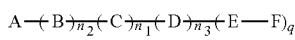

wherein:
A is the antisense oligonucleotide;
B is the cleavable moiety
C is the conjugate linker
D is the branching group
each E is a tether;
each F is a ligand;
$n_1$ is 0 or 1; and
q is an integer between 1 and 5.

Embodiment 1126

A conjugated antisense compound, wherein the compound has a structure represented by the formula:

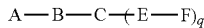

wherein
A is the antisense oligonucleotide;
B is the cleavable moiety;
C is the conjugate linker;
each E is a tether;
each F is a ligand; and
q is an integer between 1 and 5.

Embodiment 1127

A conjugated antisense compound, wherein the compound has a structure represented by the formula:

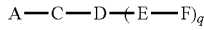

wherein
A is the antisense oligonucleotide;
C is the conjugate linker;
D is the branching group;
each E is a tether;
each F is a ligand; and
q is an integer between 1 and 5.

Embodiment 1128

A conjugated antisense compound, wherein the compound has a structure represented by the formula:

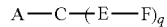

wherein
A is the antisense oligonucleotide;
C is the conjugate linker;
each E is a tether;
each F is a ligand; and
q is an integer between 1 and 5.

Embodiment 1129

A conjugated antisense compound, wherein the compound has a structure represented by the formula:

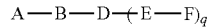

wherein
A is the antisense oligonucleotide;
B is the cleavable moiety;
D is the branching group;
each E is a tether;
each F is a ligand; and
q is an integer between 1 and 5.

Embodiment 1130

A conjugated antisense compound, wherein the compound has a structure represented by the formula:

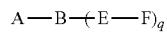

wherein
A is the antisense oligonucleotide;
B is the cleavable moiety;
each E is a tether;
each F is a ligand; and
q is an integer between 1 and 5.

Embodiment 1131

A conjugated antisense compound, wherein the compound has a structure represented by the formula:

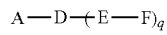

wherein
A is the antisense oligonucleotide;
D is the branching group;
each E is a tether;
each F is a ligand; and
q is an integer between 1 and 5.

311

Embodiment 1132

The conjugated antisense compound of any of claims 1124 to 1131, wherein the conjugate linker has a structure selected from among:

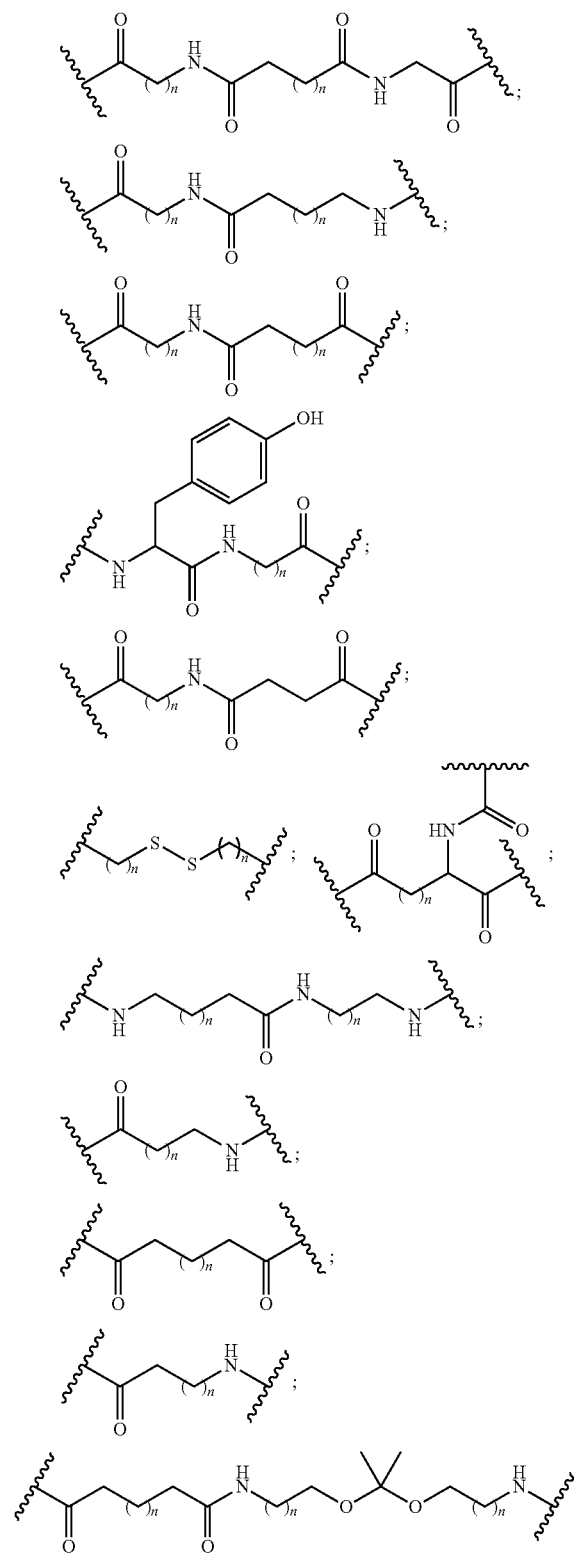

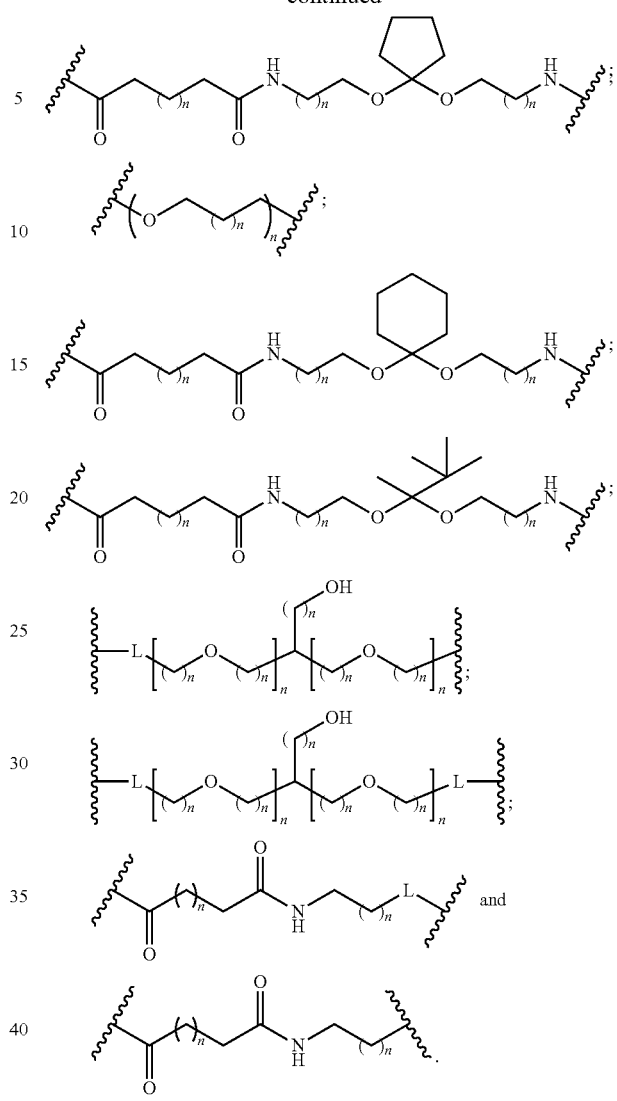

wherein each L is, independently, a phosphorus linking group or a neutral linking group; and each n is, independently, from 1 to 20.

Embodiment 1133

The conjugated antisense compound of any of claims 1124 to 1131, wherein the conjugate linker has a structure selected from among:

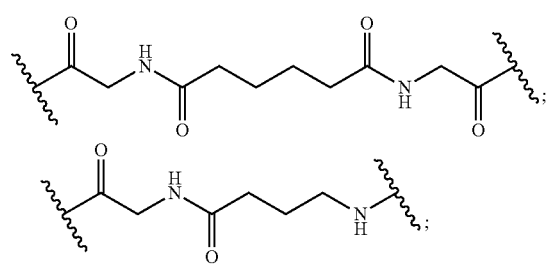

-continued
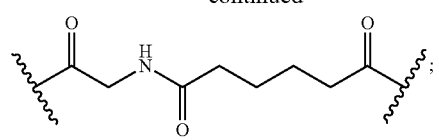
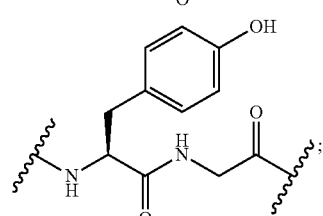
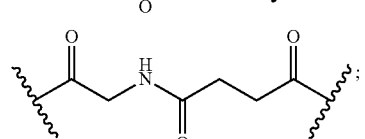
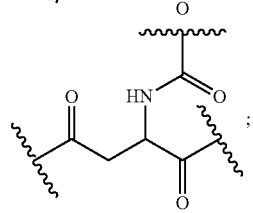
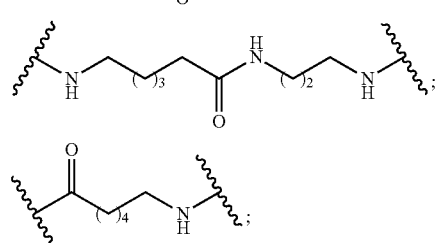
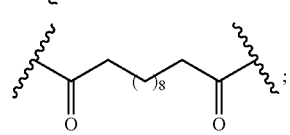
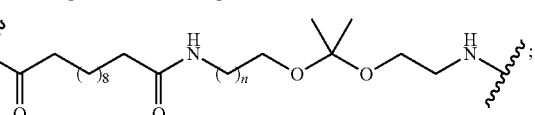
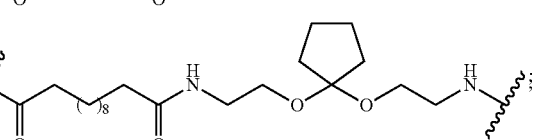
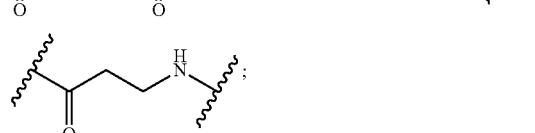
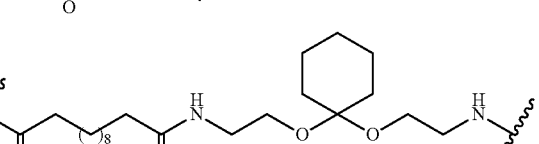
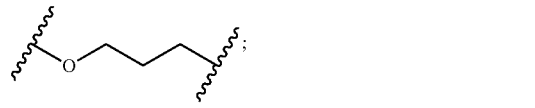
-continued
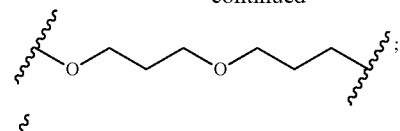
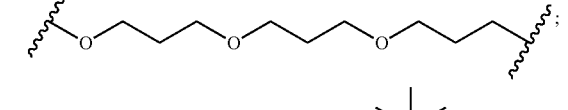
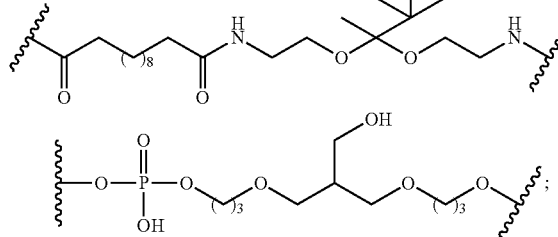
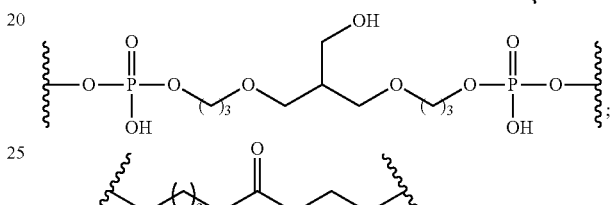
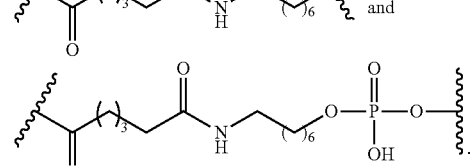
Embodiment 1134
The conjugated antisense compound of any of claims 1124 to 1131, wherein the conjugate linker has the structure:
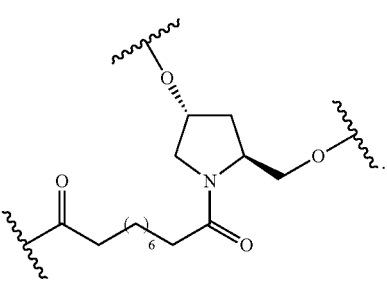
Embodiment 1135
The conjugated antisense compound of any of claims 1124 to 1131, wherein the conjugate linker has one of the structures selected from:
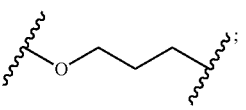

-continued

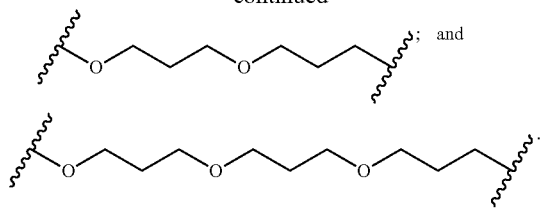; and

Embodiment 1136

The conjugated antisense compound of any of claims 1124 to 1131, wherein the conjugate linker has one of the structures selected from:

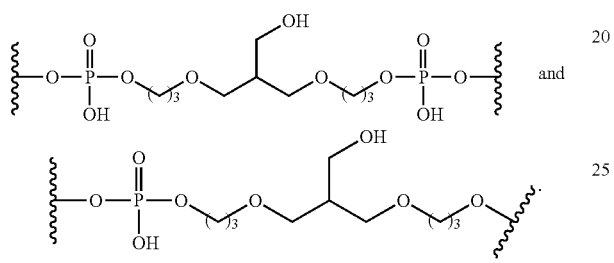

Embodiment 1137

The conjugated antisense compound of any of claims 1124 to 1131, wherein the conjugate linker has one of the structures selected from:

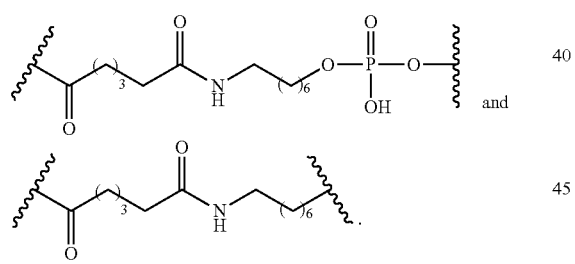

Embodiment 1138

The conjugated antisense compound of any of claims 1124 to 1131, wherein the conjugate linker comprises a pyrrolidine.

Embodiment 1139

The conjugated antisense compound of any of claims 1124 to 1131, wherein the conjugate linker does not comprise a pyrrolidine.

Embodiment 1140

The conjugated antisense compound of any of claims 1124 to 1131, wherein the conjugate linker comprises PEG.

Embodiment 1141

The conjugated antisense compound of any of claims 1124 to 1131, wherein the conjugate linker comprises an amide.

Embodiment 1142

The conjugated antisense compound of any of claims 1124 to 1131, wherein the conjugate linker does not comprise an amide.

Embodiment 1143

The conjugated antisense compound of any of claims 1124 to 1131, wherein the conjugate linker comprises a polyamide.

Embodiment 1144

The conjugated antisense compound of any of claims 1124 to 1131, wherein the conjugate linker comprises an amine Embodiment 1145

The conjugated antisense compound of any of claims 1124 to 1131, wherein the conjugate linker comprises one or more disulfide bonds.

Embodiment 1146

The conjugated antisense compound of any of claims 1124 to 1131, wherein the conjugate linker comprises a protein binding moiety.

Embodiment 1147

The conjugated antisense compound of claim 1146, wherein the protein binding moiety comprises a lipid.

Embodiment 1148

The conjugated antisense compound of claim 1146, wherein the protein binding moiety is selected from among: cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid.

Embodiment 1149

The conjugated antisense compound of any of claims 1146 to 1147 wherein the protein binding moiety is a C16 to C22 long chain saturated or unsaturated fatty acid, cholesterol, cholic acid, vitamin E, adamantane or 1-pentafluoropropyl.

Embodiment 1150
The conjugated antisense compound of any of claims 1124 to 1128, wherein the conjugate linker has a structure selected from among:
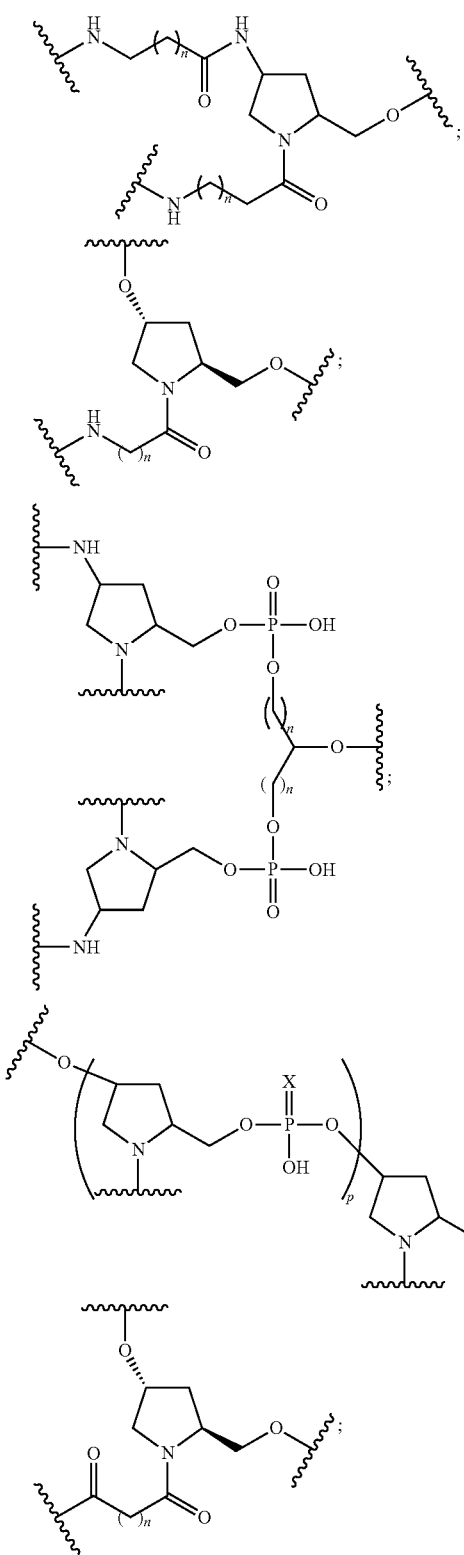
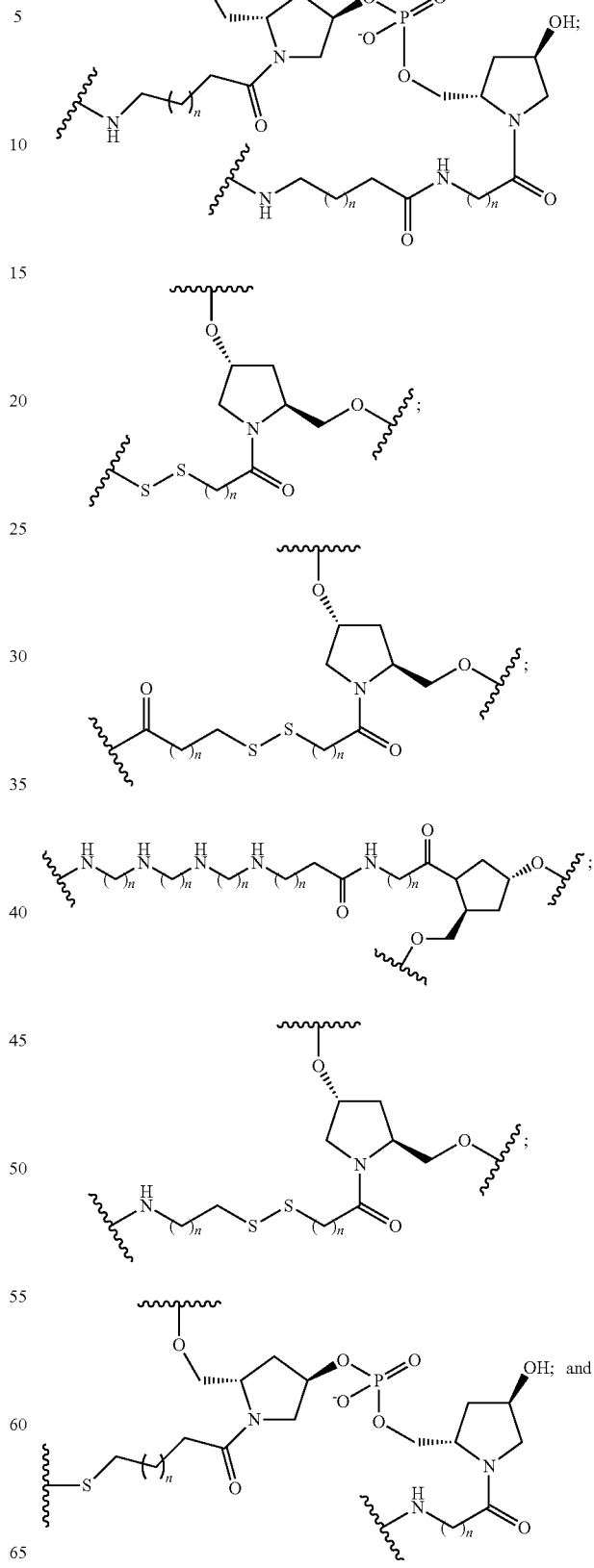

-continued
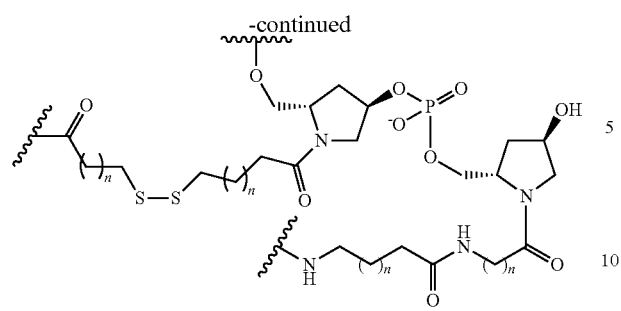
wherein each n is, independently, is from 1 to 20; and p is from 1 to 6.
Embodiment 1151
The conjugated antisense compound of any of claims 1124 to 1128 wherein the conjugate linker has a structure selected from among:
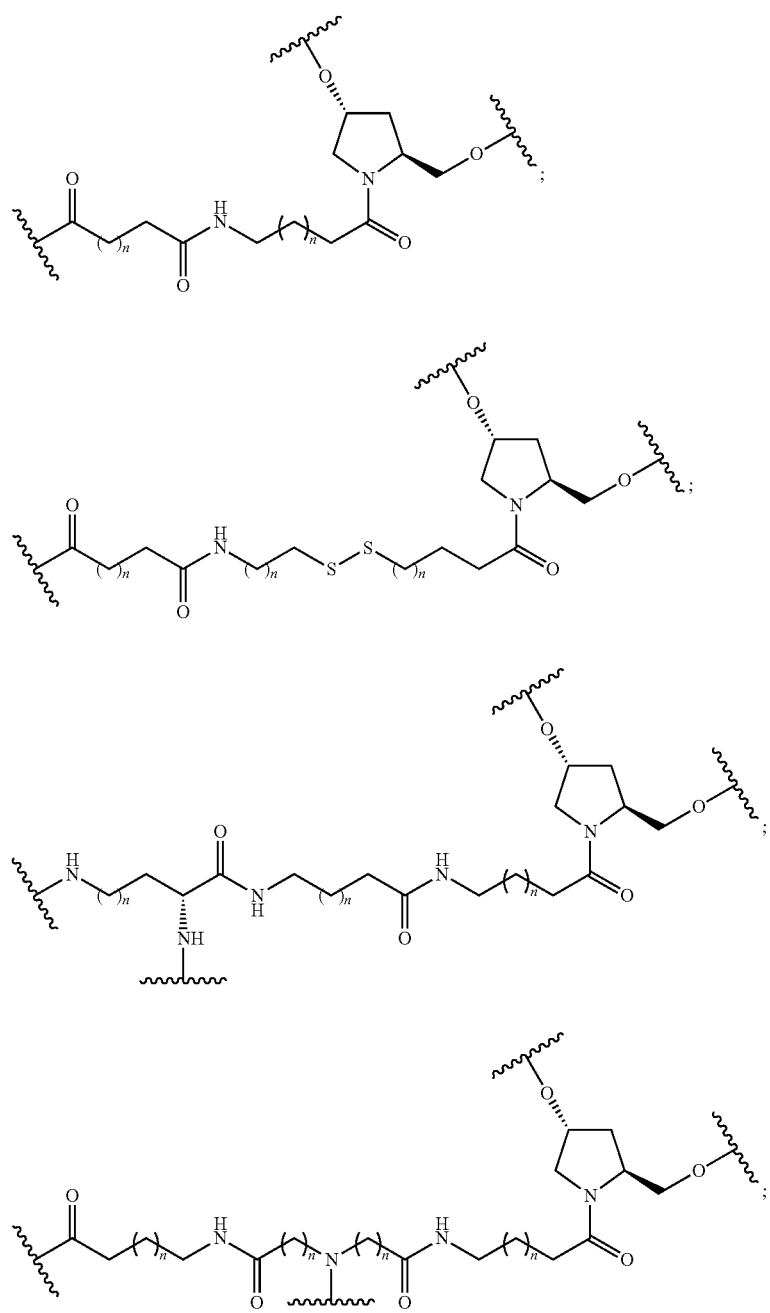

-continued
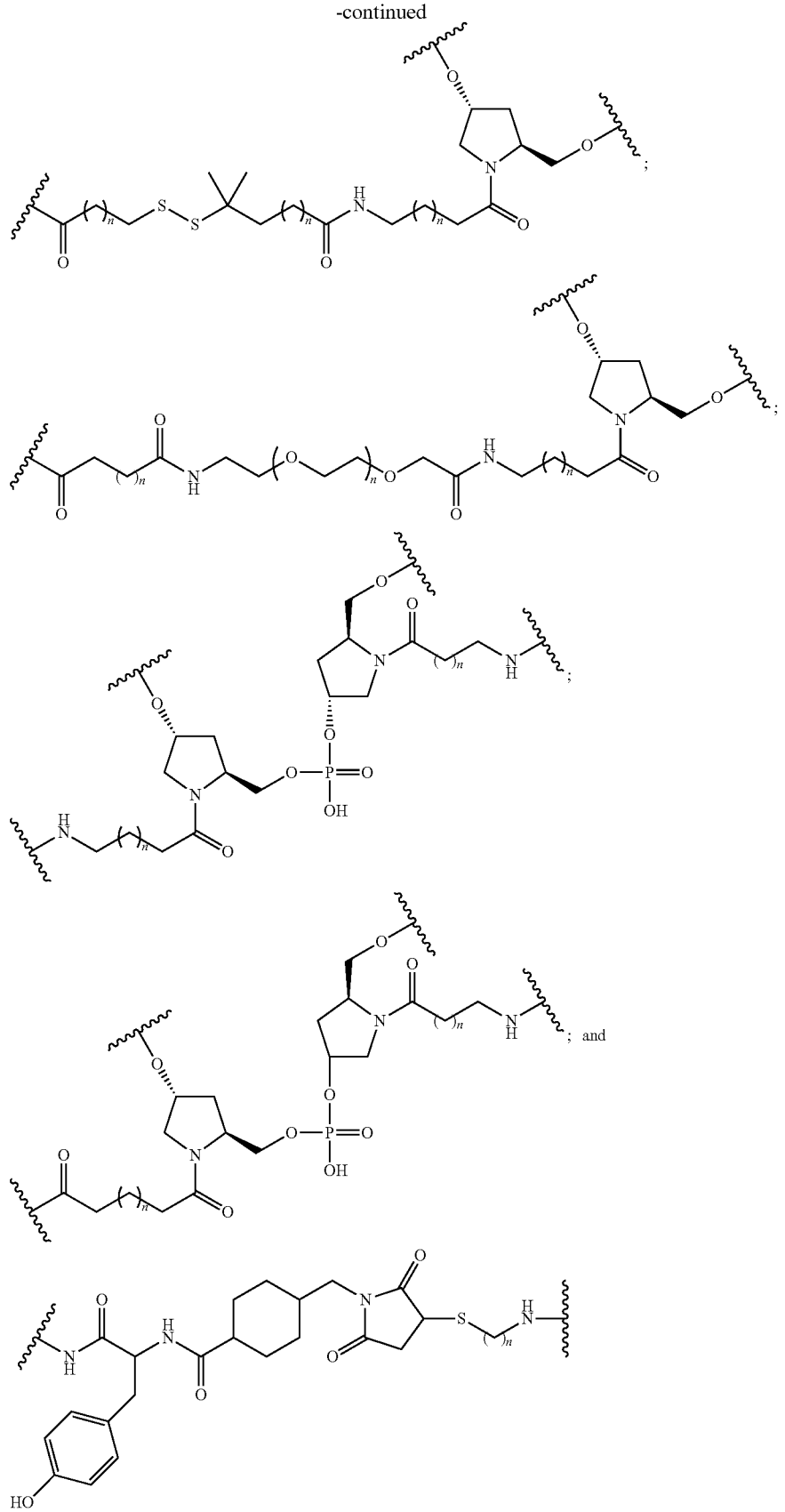
wherein each n is, independently, from 1 to 20.

323
Embodiment 1152
The conjugated antisense compound of any of claims 1124 to 1128 wherein the conjugate linker has a structure selected from among:
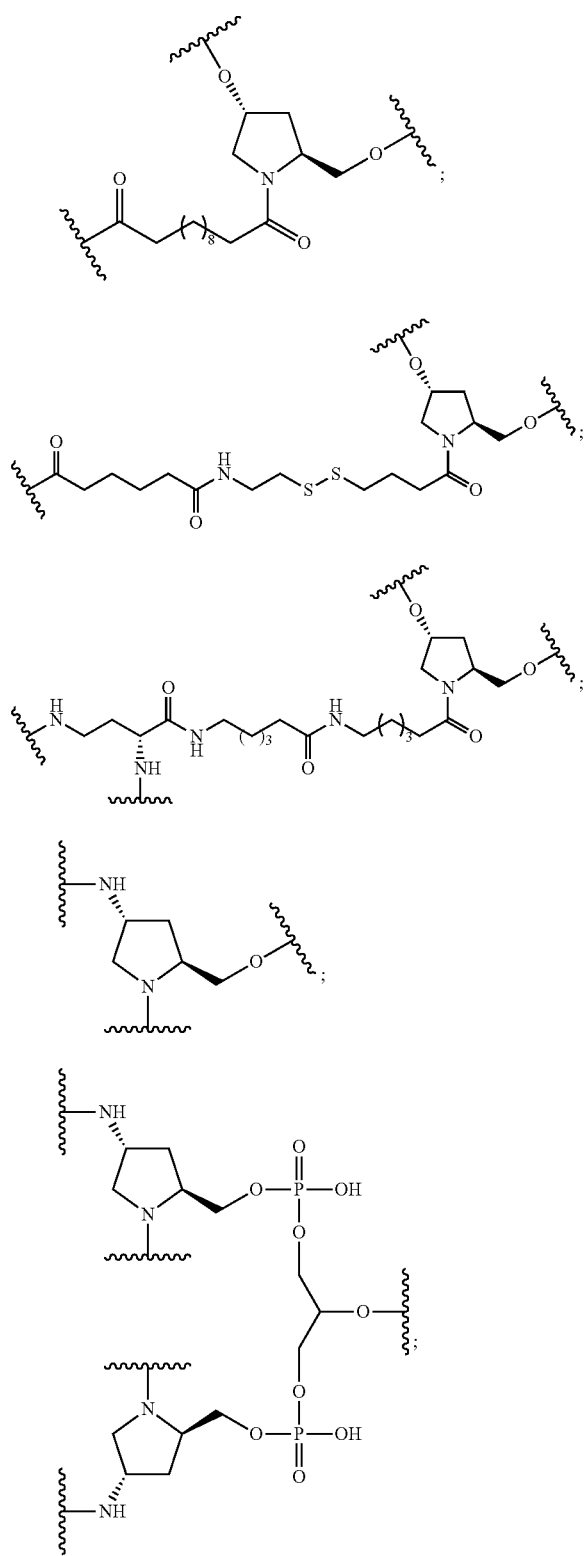
324
-continued
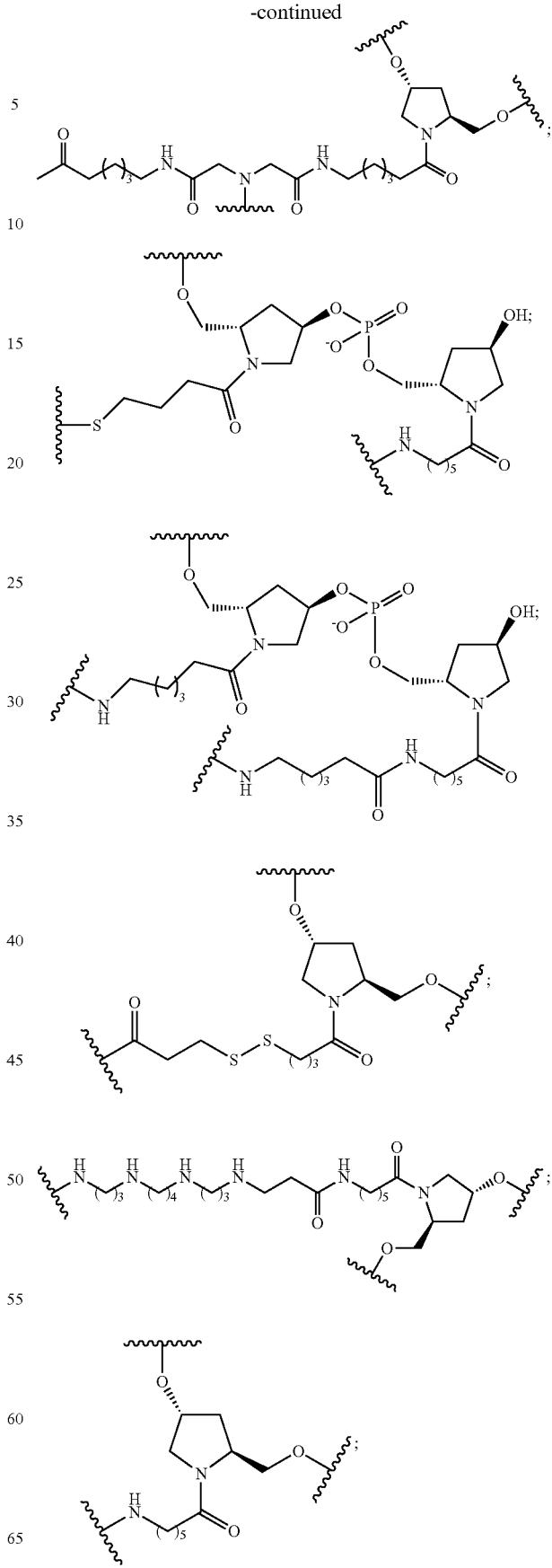

-continued

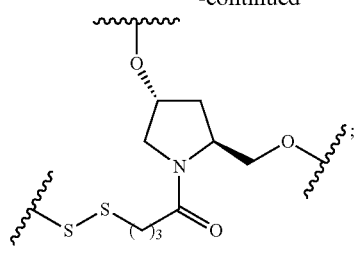

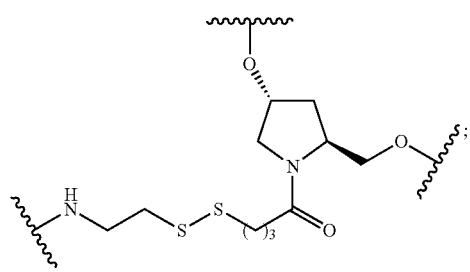

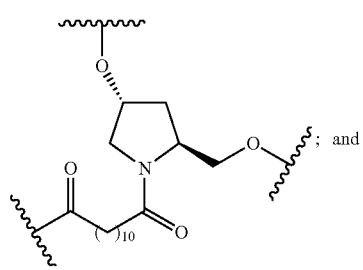

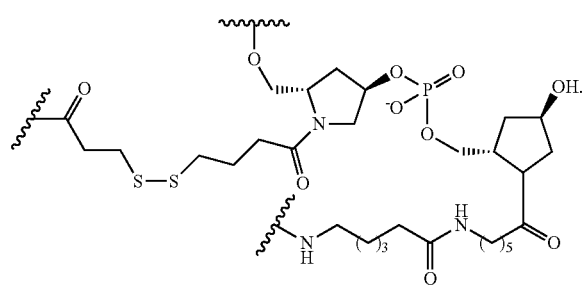

Embodiment 1153

The conjugated antisense compound of any of claims 1124 to 1128 wherein the conjugate linker has a structure selected from among:

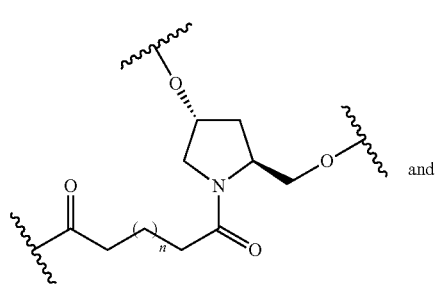

and

-continued

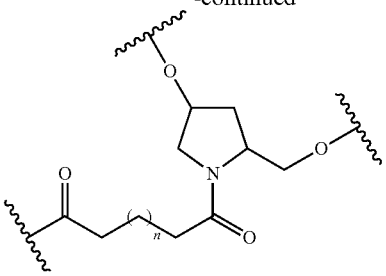

wherein n is from 1 to 20.

Embodiment 1154

The conjugated antisense compound of claims 1124 to 1154, wherein the branching group has one of the following structures:

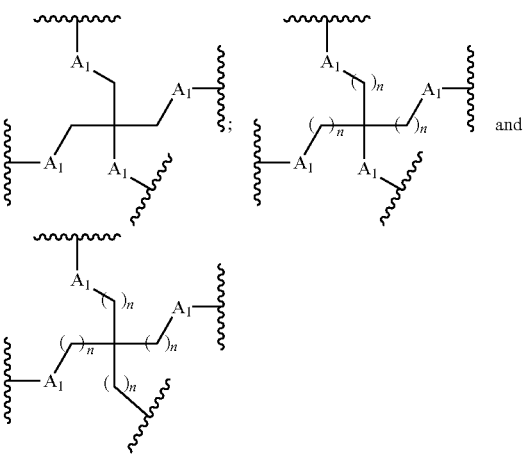

wherein each $A_1$ is independently, O, S, C=O or NH; and each n is, independently, from 1 to 20.

Embodiment 1155

The conjugated antisense compound of claims 1124 to 1154, wherein the branching group has one of the following structures:

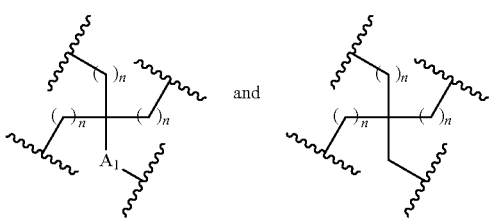

wherein each $A_1$ is independently, O, S, C=O or NH; and each n is, independently, from 1 to 20.

Embodiment 1156

The conjugated antisense compound of claims 1124 to 1154, wherein the branching group has the following structure:

Embodiment 1157

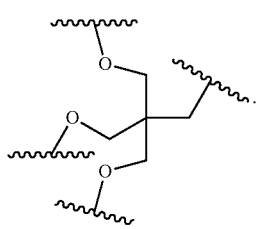 [SMILES: *CC(CO*)(CO*)CO*]

The conjugated antisense compound of claims 1124 to 1154, wherein the branching group has the following structure:

Embodiment 1158

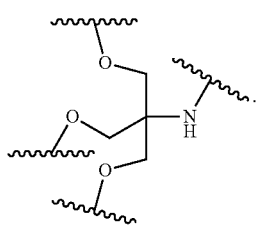 [SMILES: *NC(CO*)(CO*)CO*]

The conjugated antisense compound of claims 1124 to 1154, wherein the branching group has the following structure:

Embodiment 1159

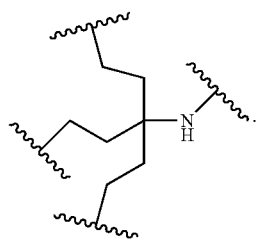 [SMILES: *CCC(CC*)(CC*)N*]

The conjugated antisense compound of claims 1124 to 1154, wherein the branching group has the following structure:

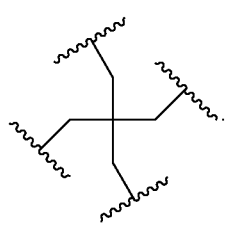 [SMILES: *CC(C*)(C*)C*]

Embodiment 1160

The conjugated antisense compound of any of claims 1124 to 1154, wherein the branching group comprises an ether.

Embodiment 1161

The conjugated antisense compound of claims 1124 to 1154, wherein the branching group has the following structure:

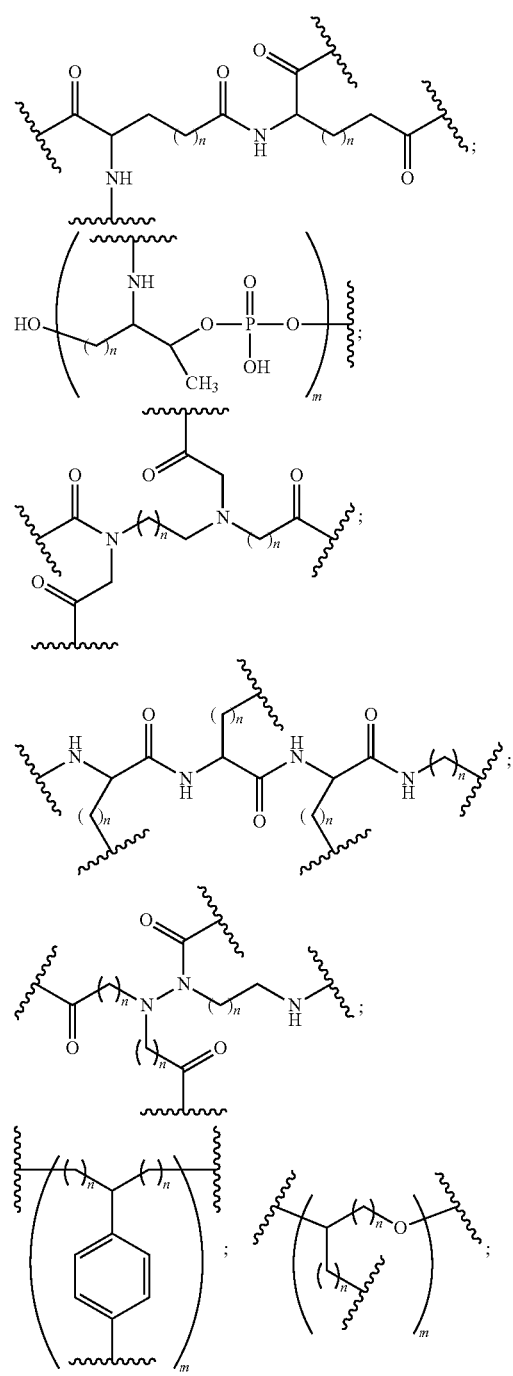

-continued
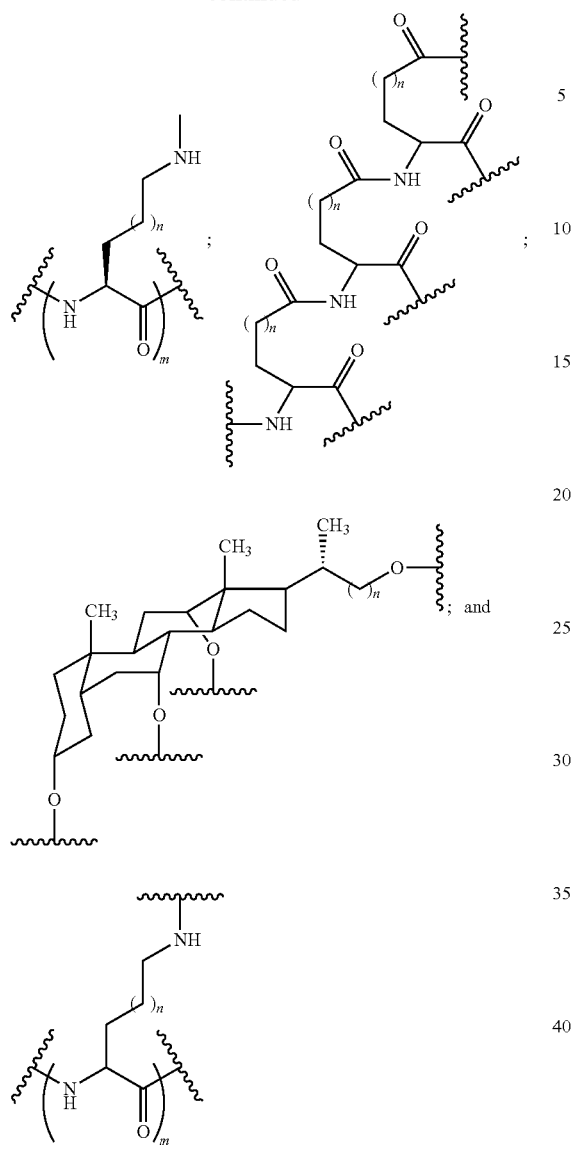
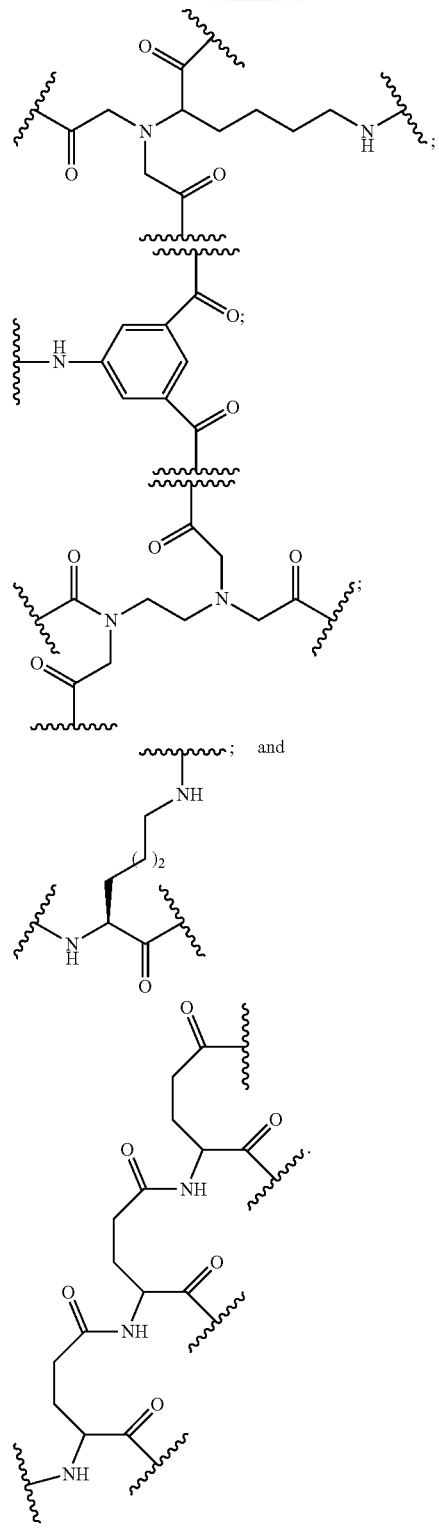
each n is, independently, from 1 to 20; and
m is from 2 to 6.
Embodiment 1162
The conjugated antisense compound of claims 1124 to 1154, wherein the branching group has the following structure:
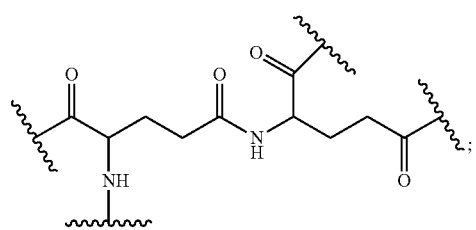
Embodiment 1163
The conjugated antisense compound of claims 1124 to 1154, wherein the branching group has the following structure:

331
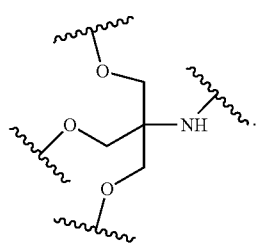 [SMILES: *NC(CO*)(CO*)CO*]
Embodiment 1164
The conjugated antisense compound of any of claims 1124 to 1154, wherein the branching group comprises:
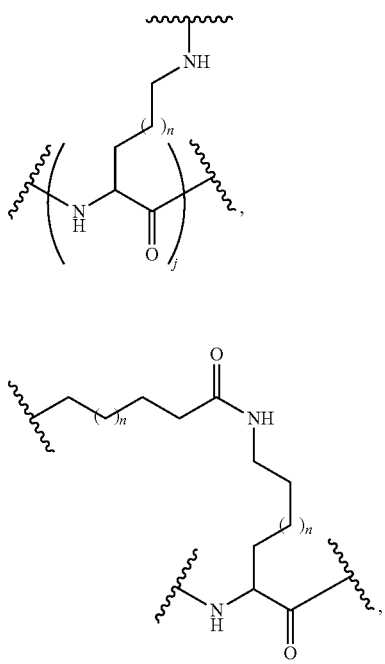
332
-continued
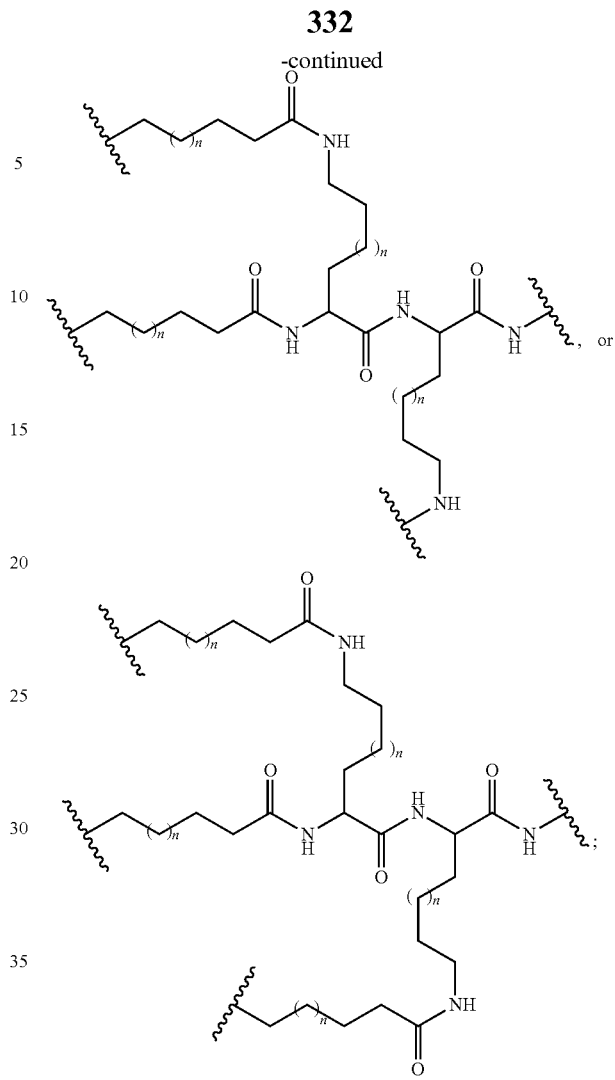
wherein each j is an integer from 1 to 3; and
wherein each n is an integer from 1 to 20.
Embodiment 1165
The conjugated antisense compound of any of claims 1124 to 1154 wherein the branching group comprises:
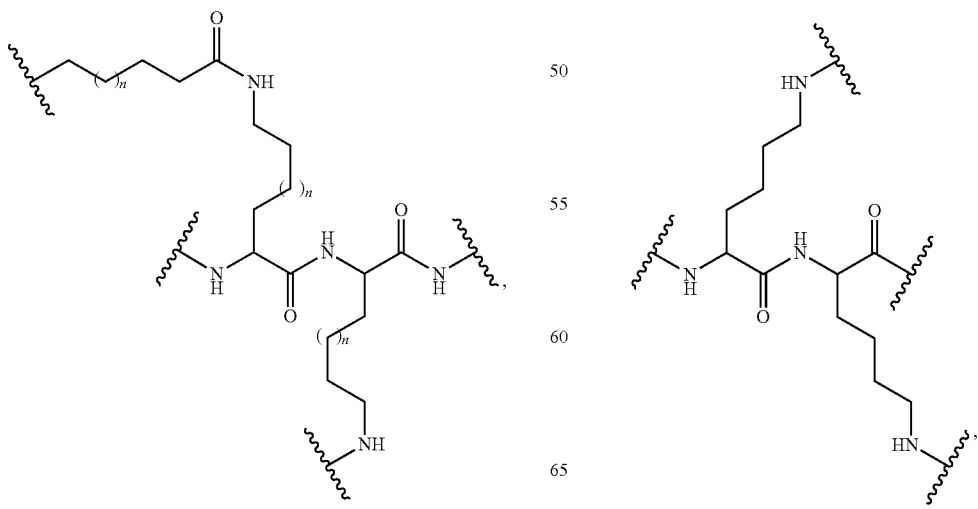

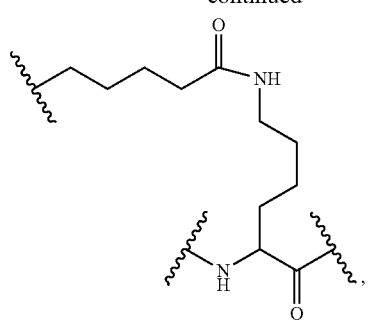

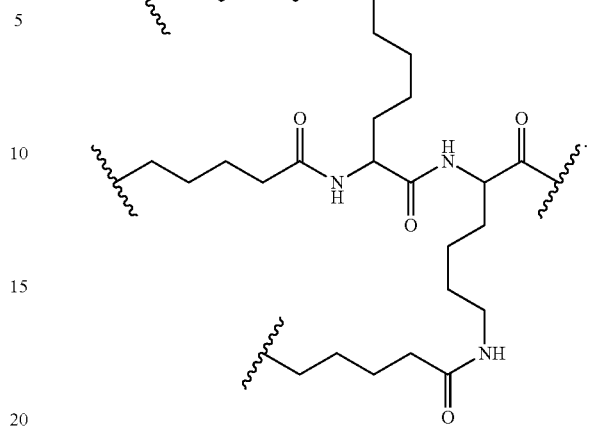

Embodiment 1166

The conjugated antisense compound of claims 1124 to 1165, wherein each tether is selected from among:

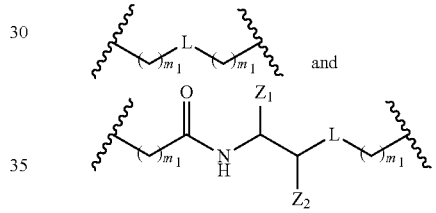

wherein L is selected from a phosphorus linking group and a neutral linking group;
$Z_1$ is $C(=O)O-R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and each $m_1$ is, independently, from 0 to 20 wherein at least one $m_1$ is greater than 0 for each tether.

Embodiment 1167

The conjugated antisense compound of claims 1124 to 1165, wherein each tether is selected from among:

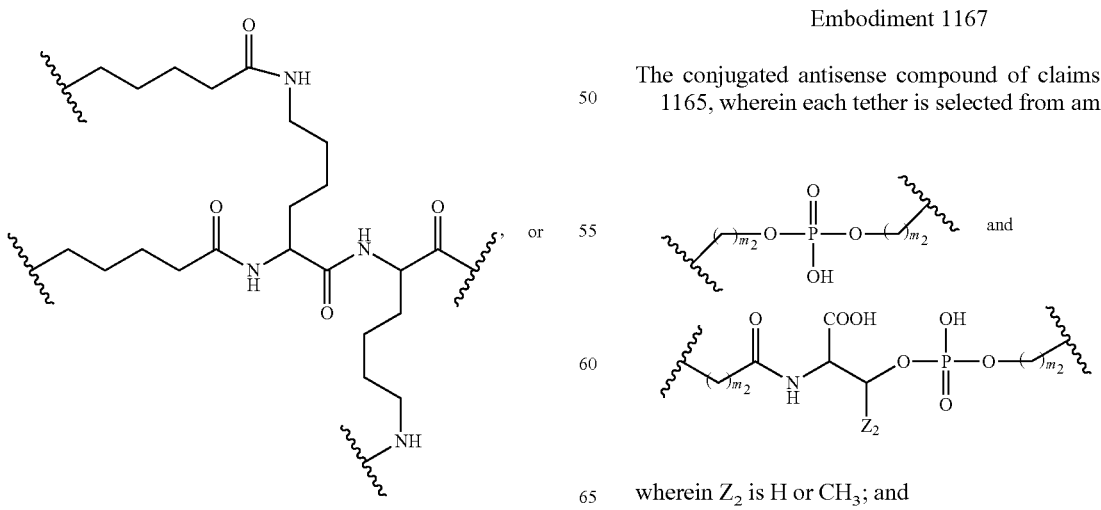

wherein $Z_2$ is H or $CH_3$; and
each $m_2$ is, independently, from 0 to 20 wherein at least one $m_2$ is greater than 0 for each tether.

Embodiment 1168

The conjugated antisense compound of claims 1124 to 1165, wherein each tether is selected from among:

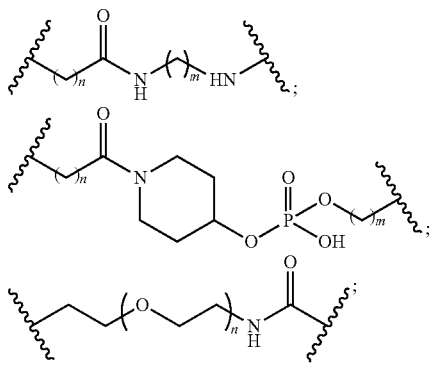

wherein n is from 1 to 12; and
wherein m is from 1 to 12.

Embodiment 1169

The conjugated antisense compound of any of claims 1124 to 1165, wherein at least one tether comprises PEG.

Embodiment 1170

The conjugated antisense compound of any of claims 1124 to 1165, wherein at least one tether comprises an amide.

Embodiment 1171

The conjugated antisense compound of any of claims 1124 to 1165, wherein at least one tether comprises a polyamide.

Embodiment 1172

The conjugated antisense compound of any of claims 1124 to 1165, wherein at least one tether comprises an amine

Embodiment 1173

The conjugated antisense compound of any of claims 1124 to 1165, wherein at least two tethers are different from one another.

Embodiment 1174

The conjugated antisense compound of any of claims 1124 to 1165, wherein all of the tethers are the same as one another.

Embodiment 1175

The conjugated antisense compound of any of claims 1124 to 1165, wherein each tether is selected from among:

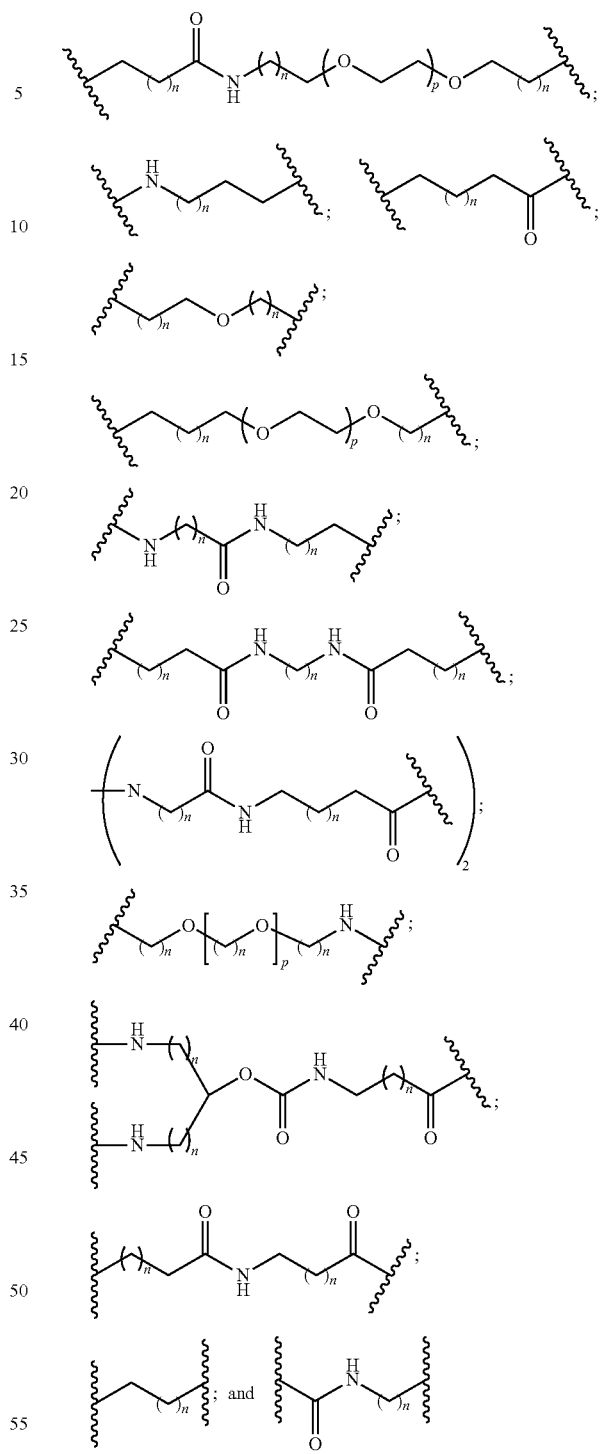

wherein each n is, independently, from 1 to 20; and
each p is from 1 to about 6.

Embodiment 1176

The conjugated antisense compound of any of claims 1124 to 1165, wherein each tether is selected from among:

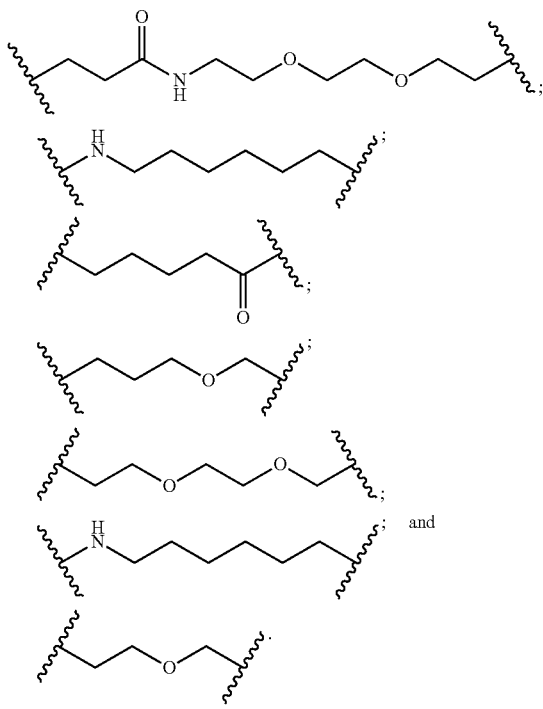

Embodiment 1177

The conjugated antisense compound of any of claims 1124 to 1165, wherein each tether has the following structure:

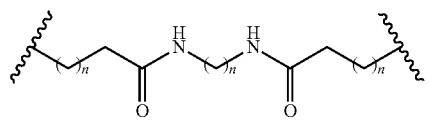

wherein each n is, independently, from 1 to 20.

Embodiment 1178

The conjugated antisense compound of any of claims 1124 to 1165, wherein each tether has the following structure:

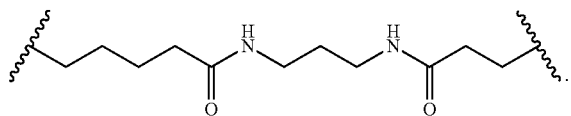 [SMILES: *CCCCC(=O)NCCCNC(=O)CC*]

Embodiment 1179

The conjugated antisense compound of any of claims 1124 to 1178, wherein the cell-targeting moiety comprises at least one ligand.

Embodiment 1180

The conjugated antisense compound of any of claims 1124 to 1178, wherein the cell-targeting moiety comprises one ligand.

Embodiment 1181

The conjugated antisense compound of any of claims 1124 to 1178, wherein the targeting moiety comprises two ligands.

Embodiment 1182

The conjugated antisense compound of any of claims 1124 to 1178, wherein the targeting moiety comprises three ligands.

Embodiment 1183

The conjugated antisense compound of any of claims 1179 to 1182, wherein each ligand is covalently attached to each tether.

Embodiment 1184

The conjugated antisense compound of any of claims 1179 to 1182, wherein at least one ligand is N-Acetylgalactosamine (GalNAc).

Embodiment 1185

The conjugated antisense compound of any of claims 1179 to 1182, wherein each ligand is N-Acetylgalactosamine (GalNAc).

Embodiment 1186

The conjugated antisense compound of any of claims 1179 to 1182, wherein the ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, β-D-Mannofuranose, α-D-Mannopyranose, β-D-Mannopyranose, α-D-Glucopyranose, 3-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose.

Embodiment 1187

The conjugated antisense compound of any of claims 1179 to 1182, wherein the ligand is galactose.

Embodiment 1188

The conjugated antisense compound of any of claims 1179 to 1182, wherein the ligand is mannose-6-phosphate.

Embodiment 1189

The conjugated antisense compound of any of claims 1179 to 1182, wherein each ligand is selected from among:

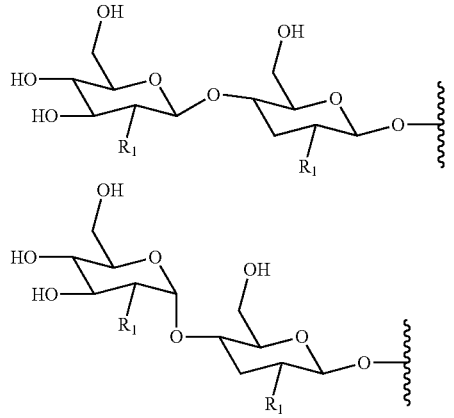

wherein each $R_1$ is selected from OH and NHCOOH.

Embodiment 1190

The conjugated antisense compound of any of claims 1179 to 1182, wherein each ligand is selected from among:

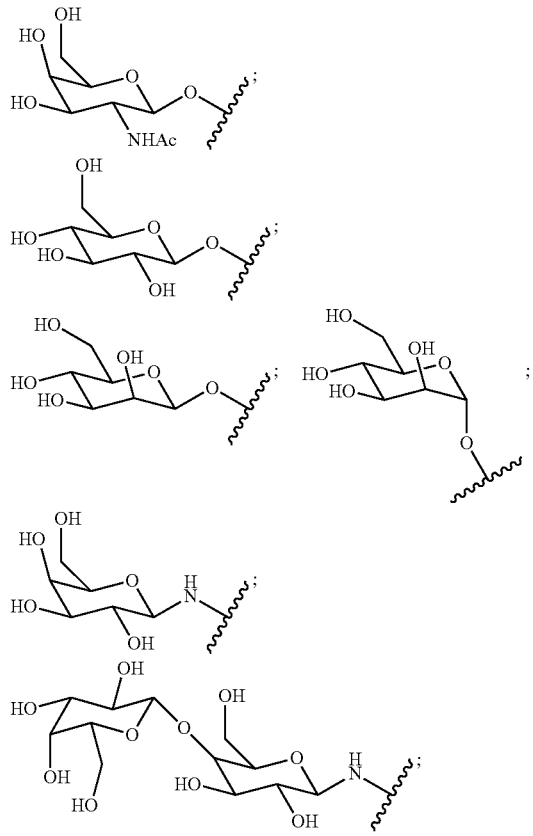

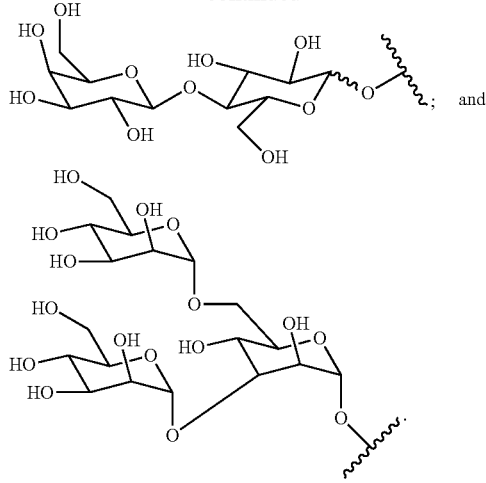

Embodiment 1191

The conjugated antisense compound of any of claims 1179 to 1182, wherein each ligand has the following structure:

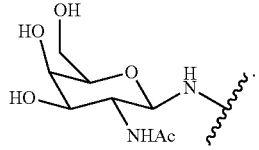

Embodiment 1192

The conjugated antisense compound of any of claims 1179 to 1182, wherein each ligand has the following structure:

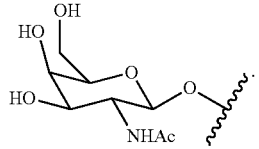

Embodiment 1193

The conjugated antisense compound of any of claims 1124 to 1153, wherein the conjugate group comprises a cell-targeting moiety having the following structure:

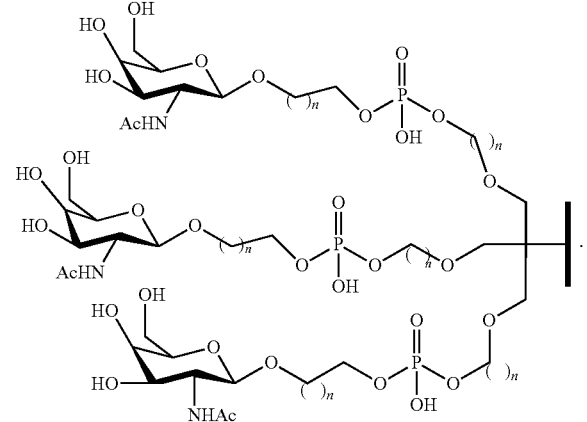

Embodiment 1194

The conjugated antisense compound of any of claims 1124 to 1153, wherein the conjugate group comprises a cell-targeting moiety having the following structure:

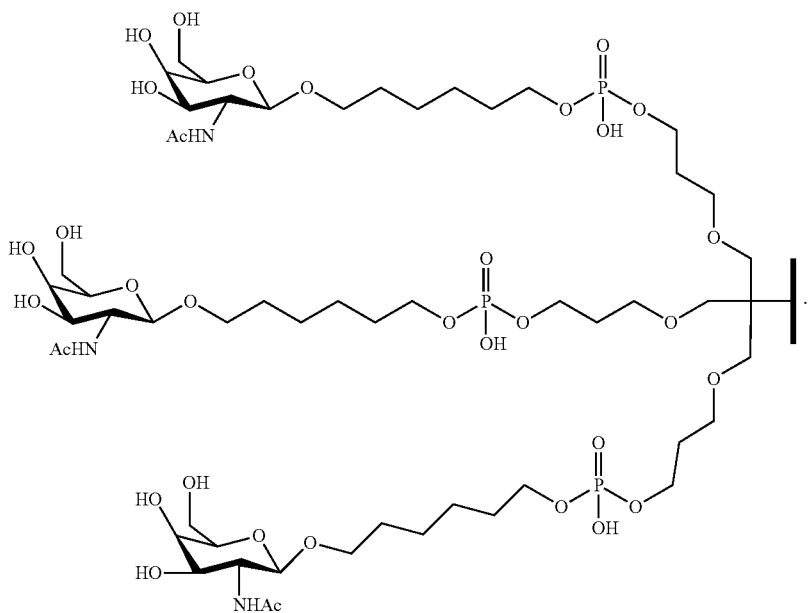

Embodiment 1195

The conjugated antisense compound of any of claims 1124 to 1153, wherein the conjugate group comprises a cell-targeting moiety having the following structure:

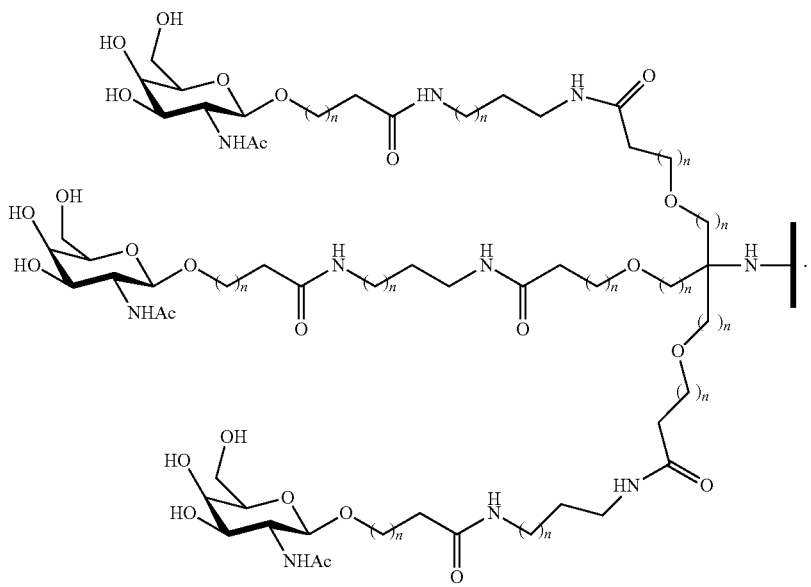

wherein each n is, independently, from 1 to 20.

Embodiment 1196
The conjugated antisense compound of any of claims 1124 to 1153, wherein the conjugate group comprises a cell-targeting moiety having the following structure:
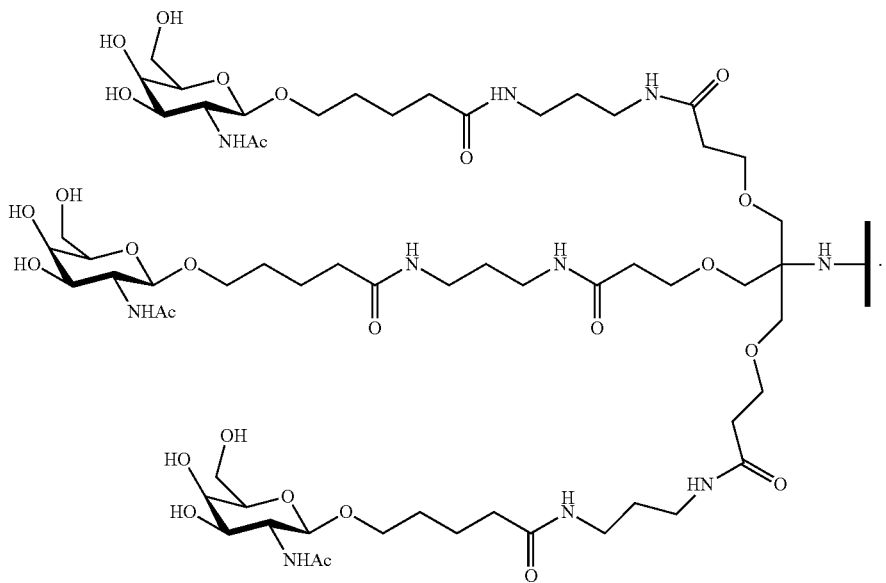
Embodiment 1197
The conjugated antisense compound of any of claims 1124 to 1153, wherein the conjugate group comprises a cell-targeting moiety having the following structure:
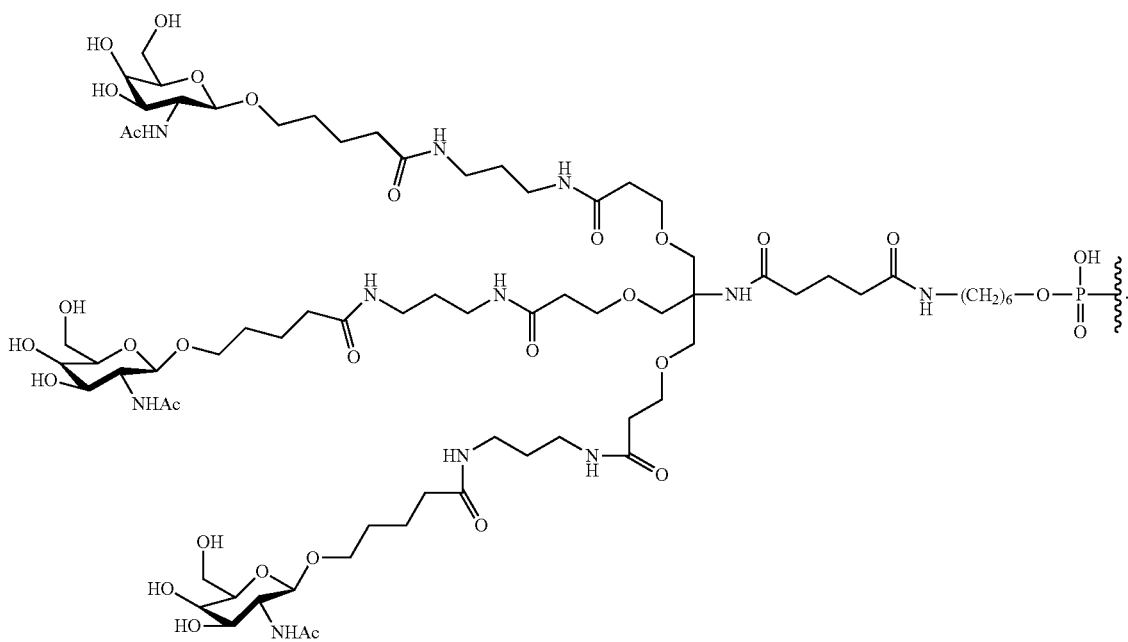

Embodiment 1198
The conjugated antisense compound of any of claims 1124 to 1153, wherein the conjugate group comprises a cell-targeting moiety having the following structure:
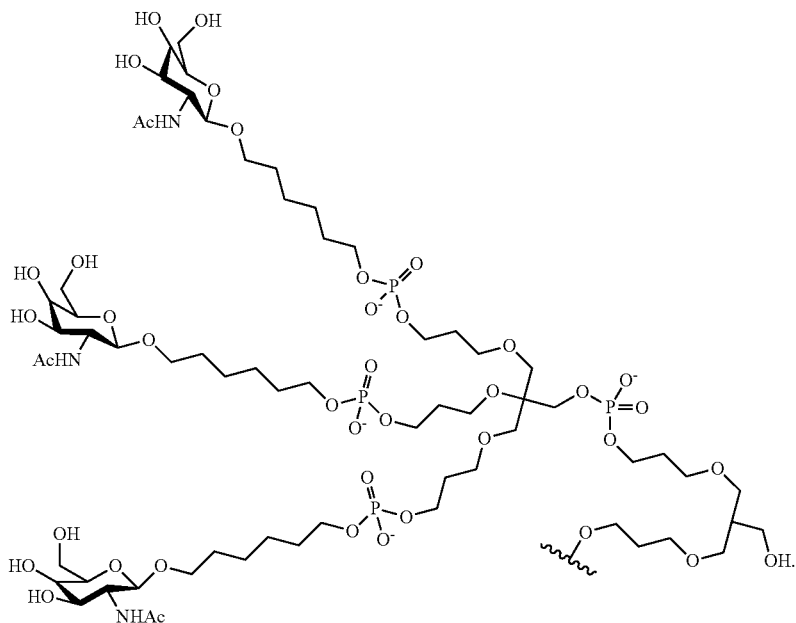
Embodiment 1199
The conjugated antisense compound of any of claims 1124 to 1153, wherein the conjugate group comprises a cell-targeting moiety having the following structure:
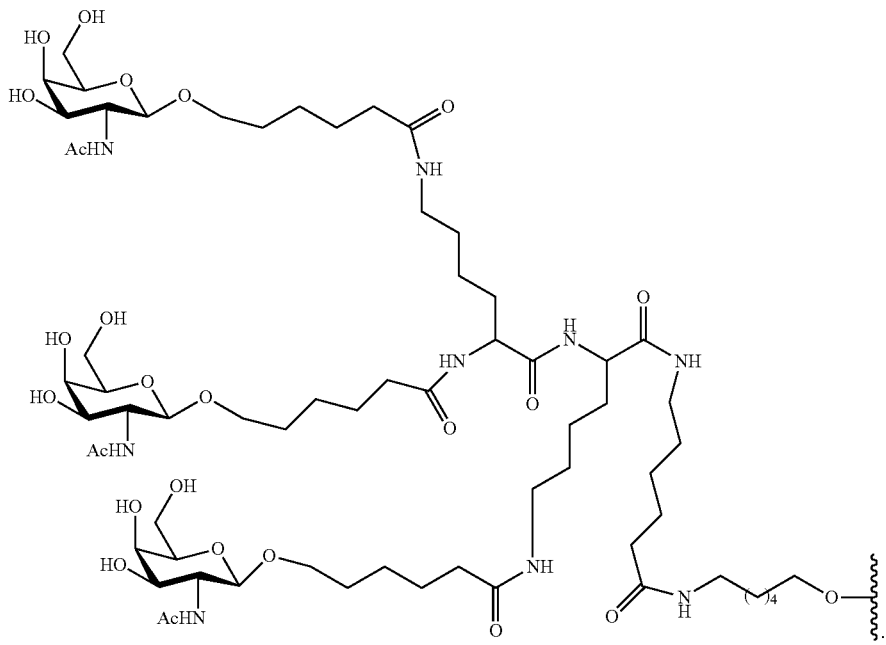

Embodiment 1200
The conjugated antisense compound of any of claims 1124 to 1153, wherein the conjugate group comprises a cell-targeting moiety having the following structure:
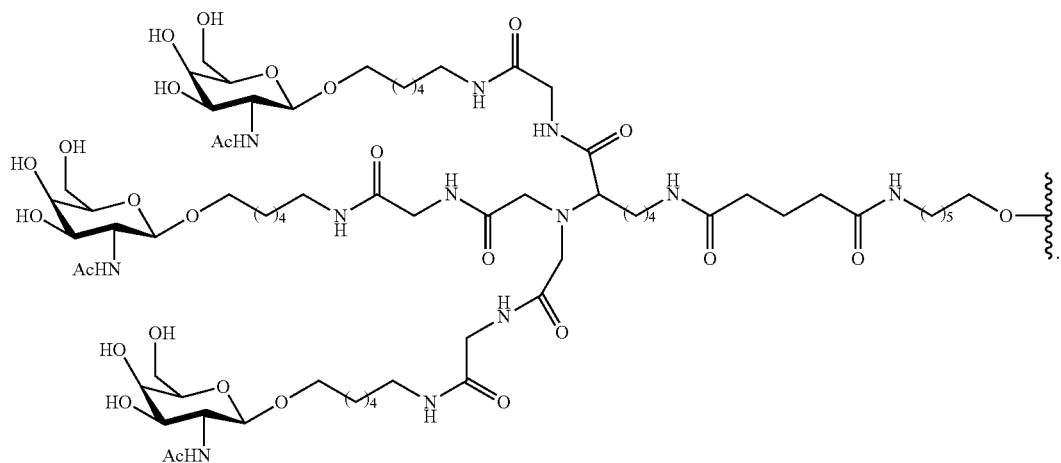
Embodiment 1201
The conjugated antisense compound of any of claims 1124 to 1153, wherein the conjugate group comprises a cell-targeting moiety having the following structure:
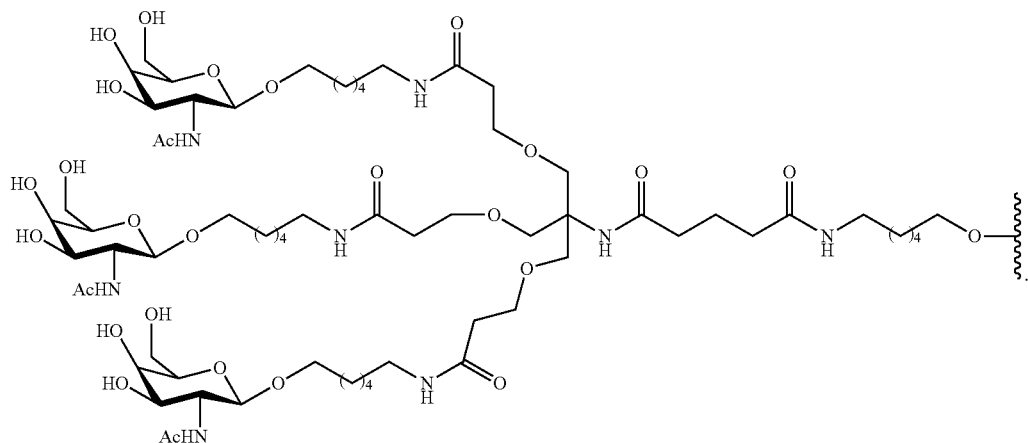

Embodiment 1202
The conjugated antisense compound of any of claims 1124 to 1153, wherein the conjugate group comprises a cell-targeting moiety having the following structure:
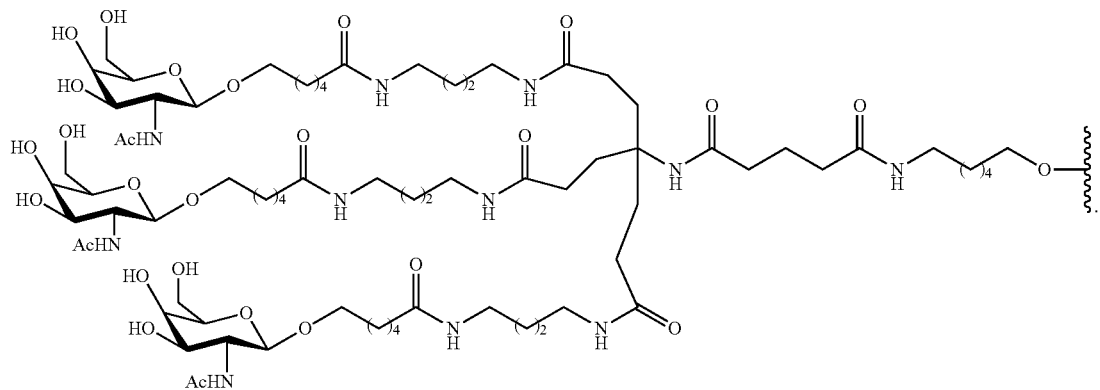
Embodiment 1203
The conjugated antisense compound of any of claims 1124 to 1153, wherein the conjugate group comprises a cell-targeting moiety having the following structure:
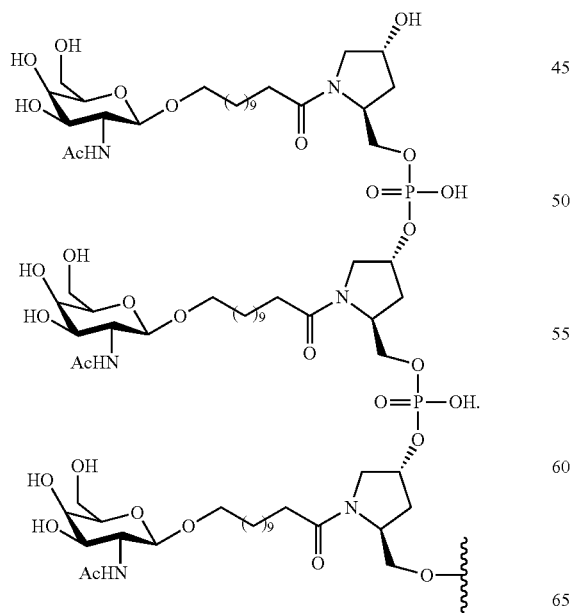

Embodiment 1204
The conjugated antisense compound of any of claims 1124 to 1153, wherein the conjugate group comprises a cell-targeting moiety having the following structure:
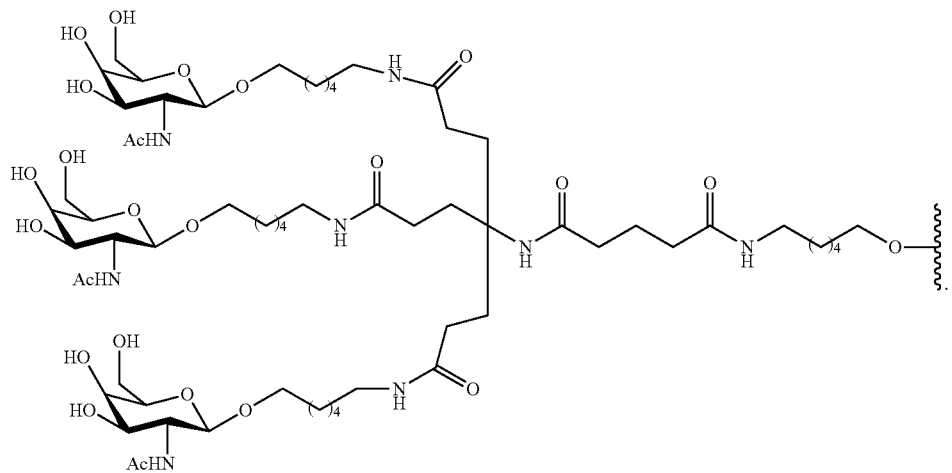
Embodiment 1205
The conjugated antisense compound of any of claims 1124 to 1153, wherein the conjugate group comprises a cell-targeting moiety having the following structure:
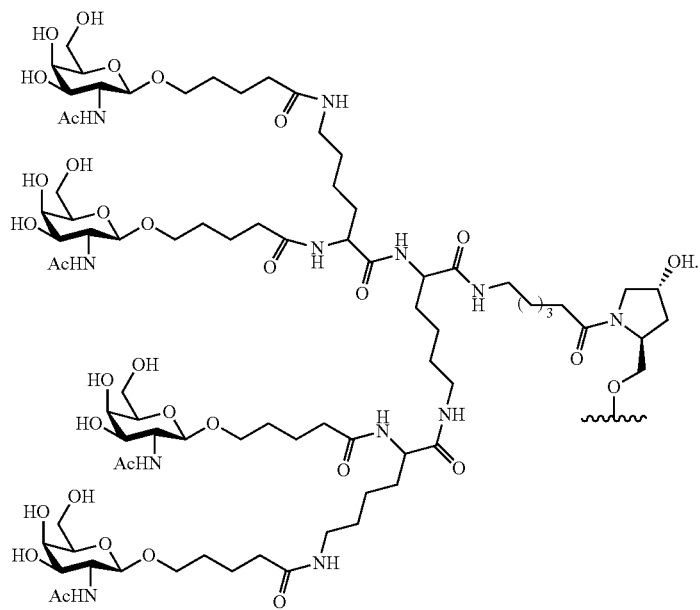

Embodiment 1206
The conjugated antisense compound of any of claims 1124 to 1153, wherein the conjugate group comprises a cell-targeting moiety having the following structure:
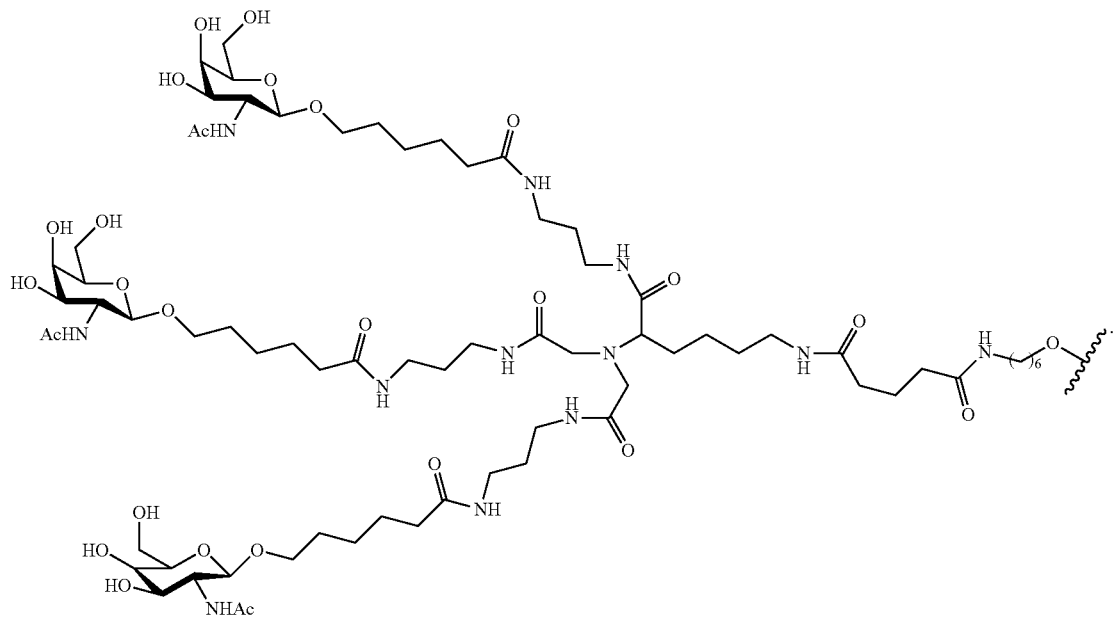
Embodiment 1207
The conjugated antisense compound of any of claims 1124 to 1153, wherein the conjugate group comprises a cell-targeting moiety having the following structure:
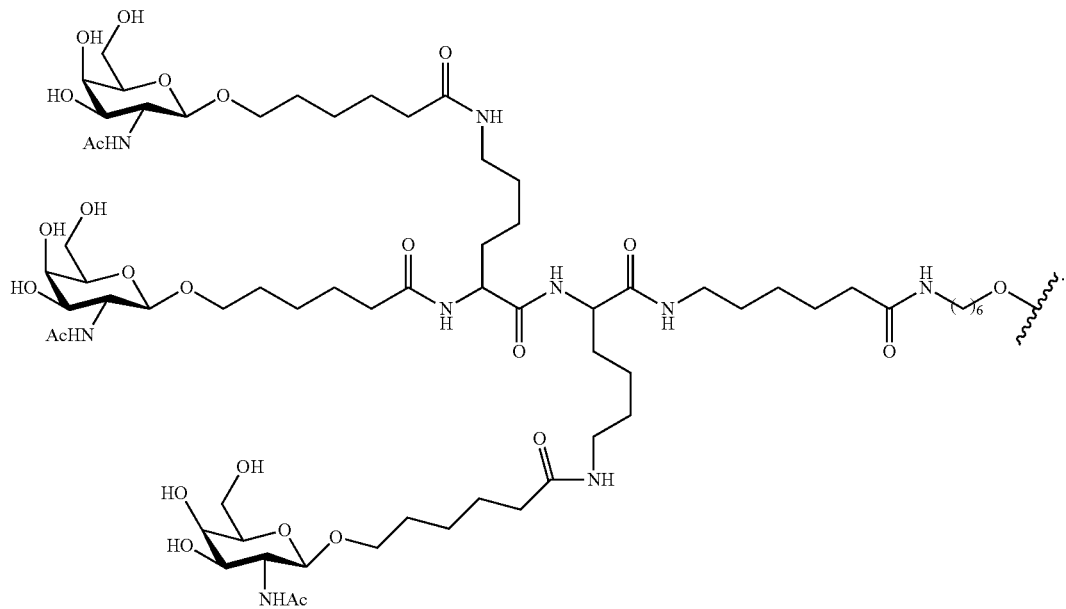

Embodiment 1208
The conjugated antisense compound of any of claims 1124 to 1153, wherein the conjugate group comprises a cell-targeting moiety having the following structure:
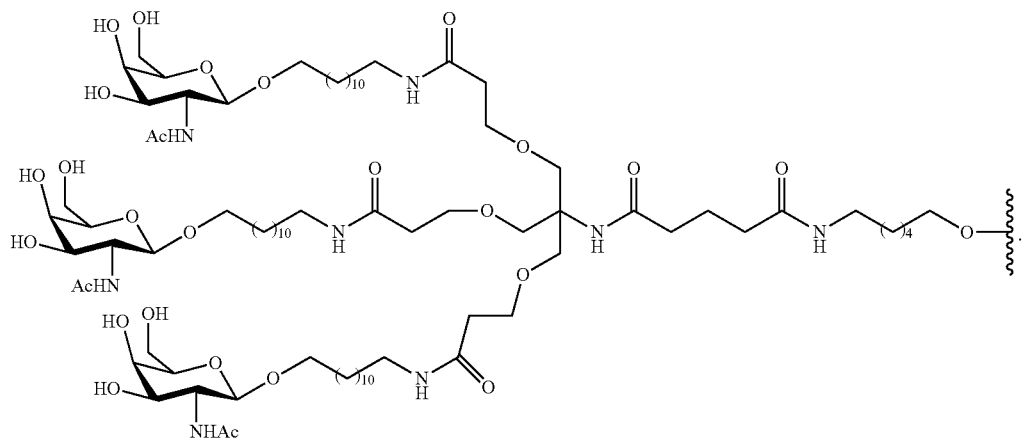
Embodiment 1209
The conjugated antisense compound of any of claims 1124 to 1153, wherein the conjugate group comprises a cell-targeting moiety having the following structure:
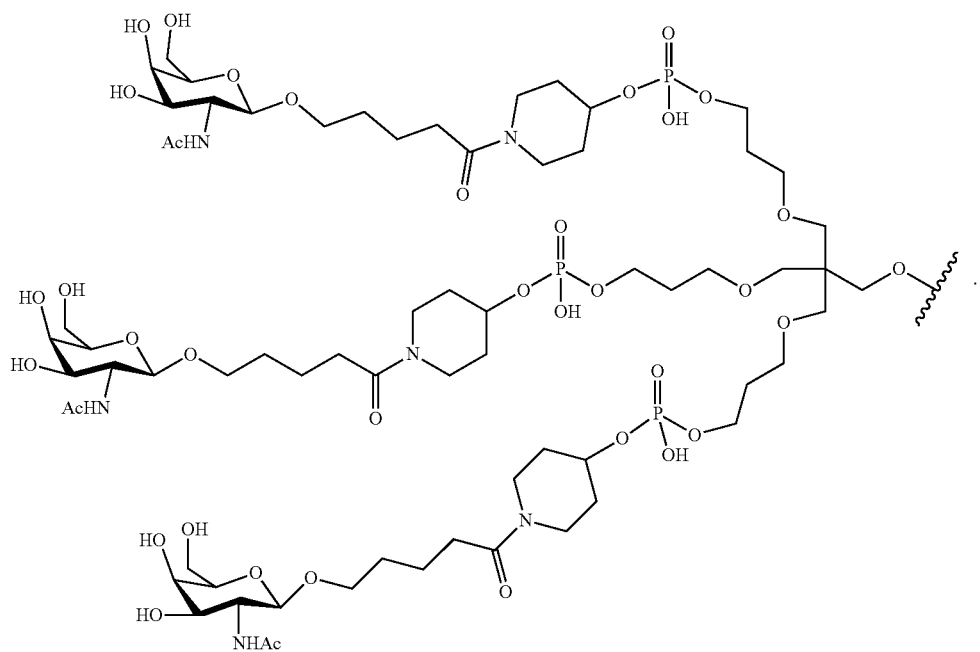

Embodiment 1210
The conjugated antisense compound of any of claims 1124 to 1153, wherein the conjugate group comprises a cell-targeting moiety having the following structure:
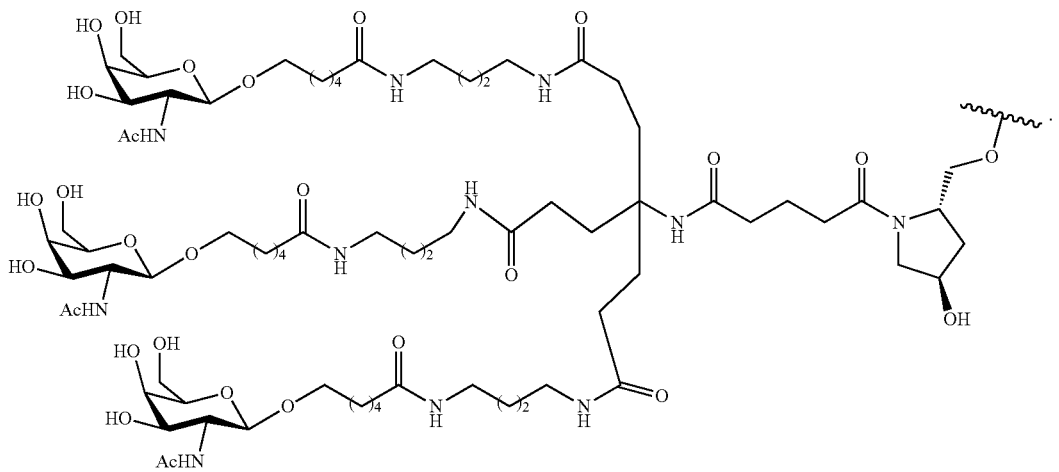
Embodiment 1211
The conjugated antisense compound of any of claims 1124 to 1153, wherein the conjugate group comprises a cell-targeting moiety having the following structure:
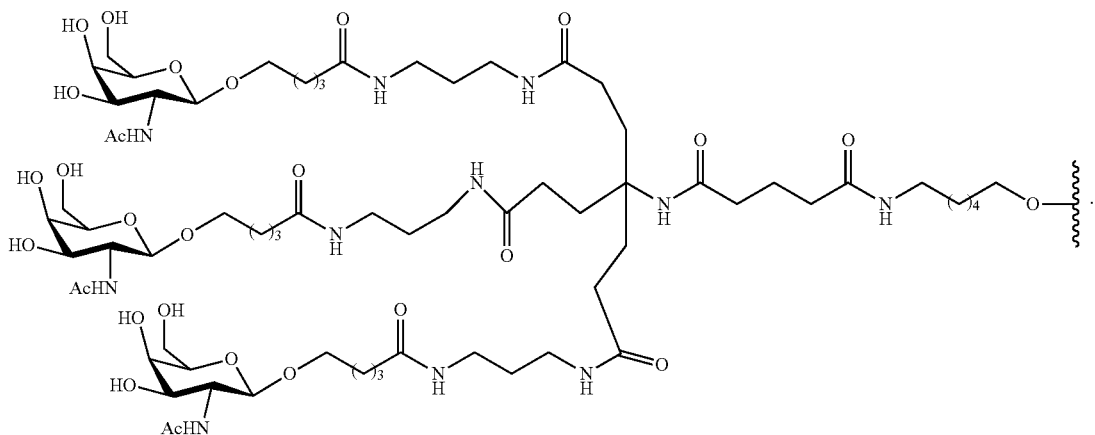

Embodiment 1212

The conjugated antisense compound of any of claims 1124 to 1153, wherein the conjugate group comprises a cell-targeting moiety having the following structure:

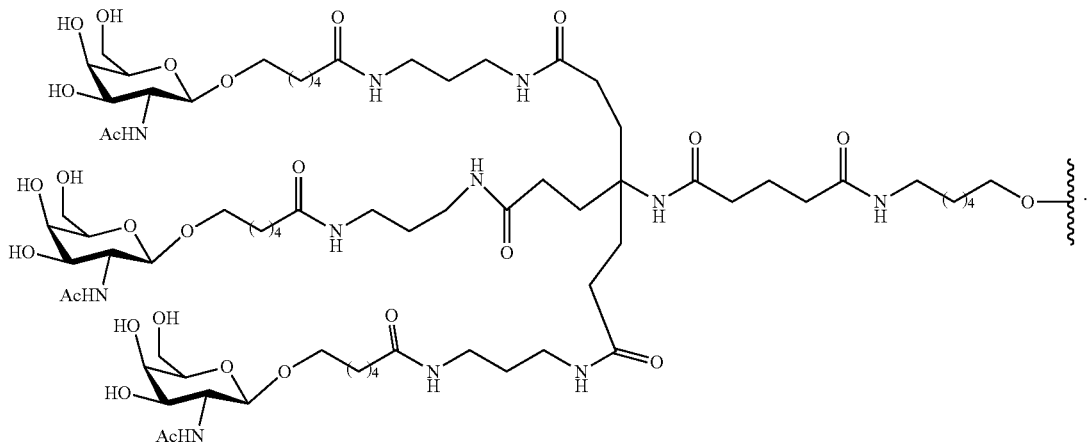

Embodiment 1213

The conjugated antisense compound of any of claims 1124 to 1153, wherein the conjugate group comprises a cell-targeting moiety having the following structure:

Embodiment 1214

The conjugated antisense compound of any of claims 1124 to 1153, wherein the conjugate group comprises a cell-targeting moiety having the following structure:

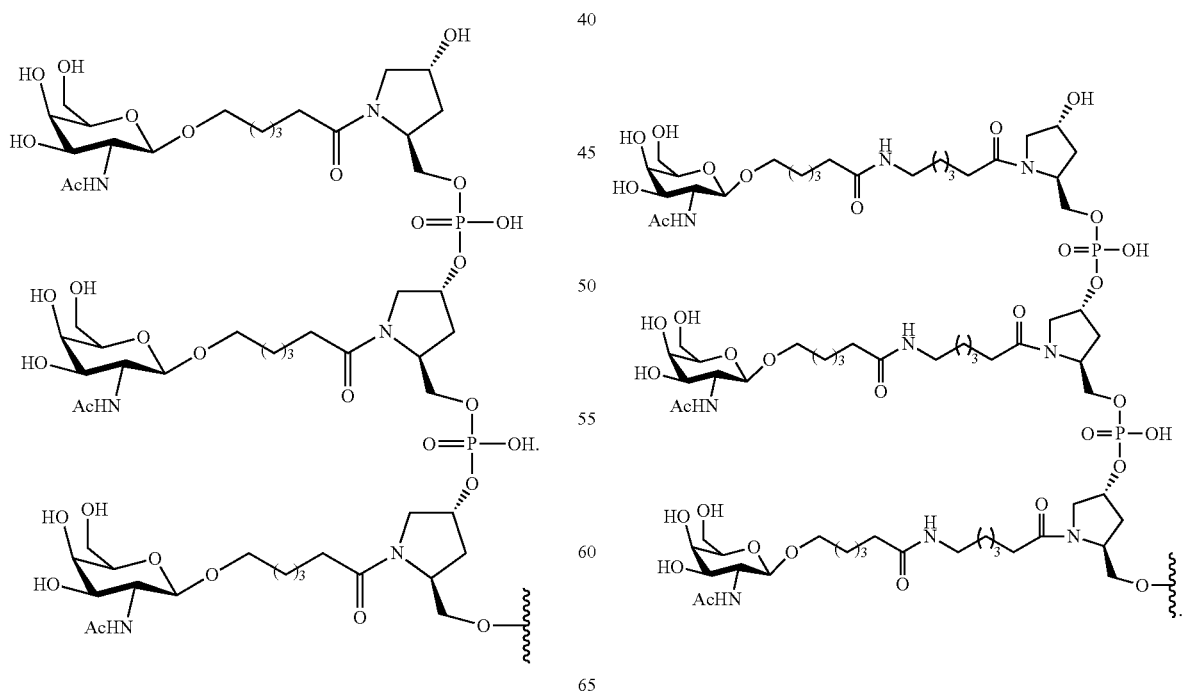

Embodiment 1215

The conjugated antisense compound of any of claims 1124 to 1153, wherein the conjugate group comprises a cell-targeting moiety having the following structure:

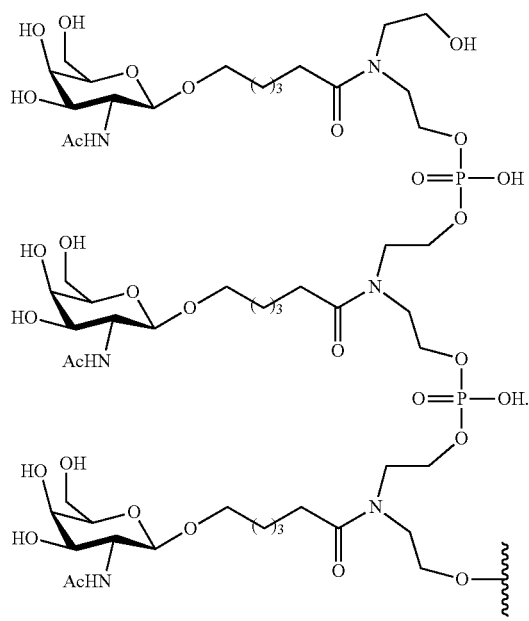

Embodiment 1216

The conjugated antisense compound of any of claims 1124 to 1153, wherein the conjugate group comprises a cell-targeting moiety having the following structure:

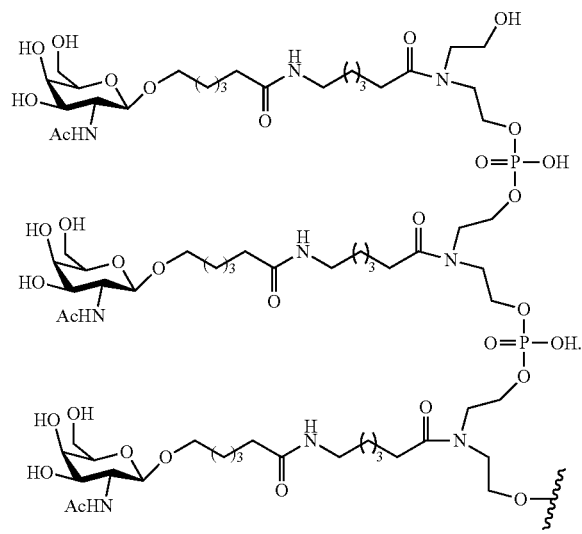

Embodiment 1217

The conjugated antisense compound of any of claims 1124 to 1131, wherein the conjugate group has the following structure:

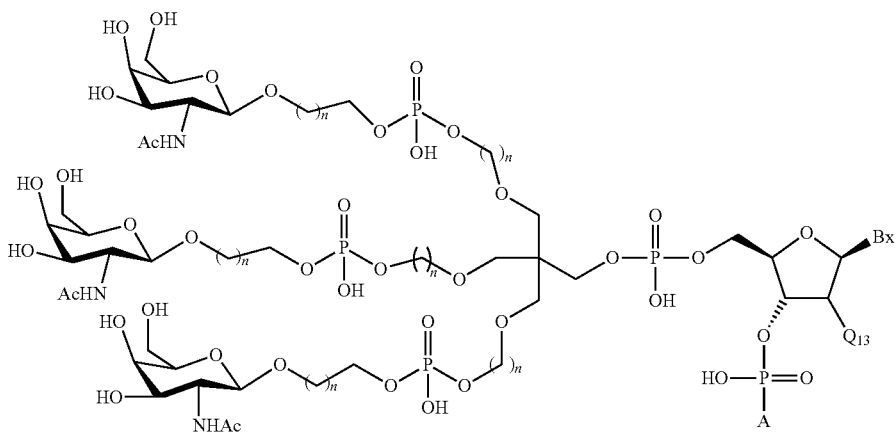

wherein each n is, independently, from 1 to 20;

$Q_{13}$ is H or $O(CH_2)_2$—$OCH_3$;

A is the antisense oligonucleotide; and

Bx is a heterocyclic base moiety.

Embodiment 1218

The conjugated antisense compound of any of claims 1124 to 1131, wherein the conjugate group has the following structure:

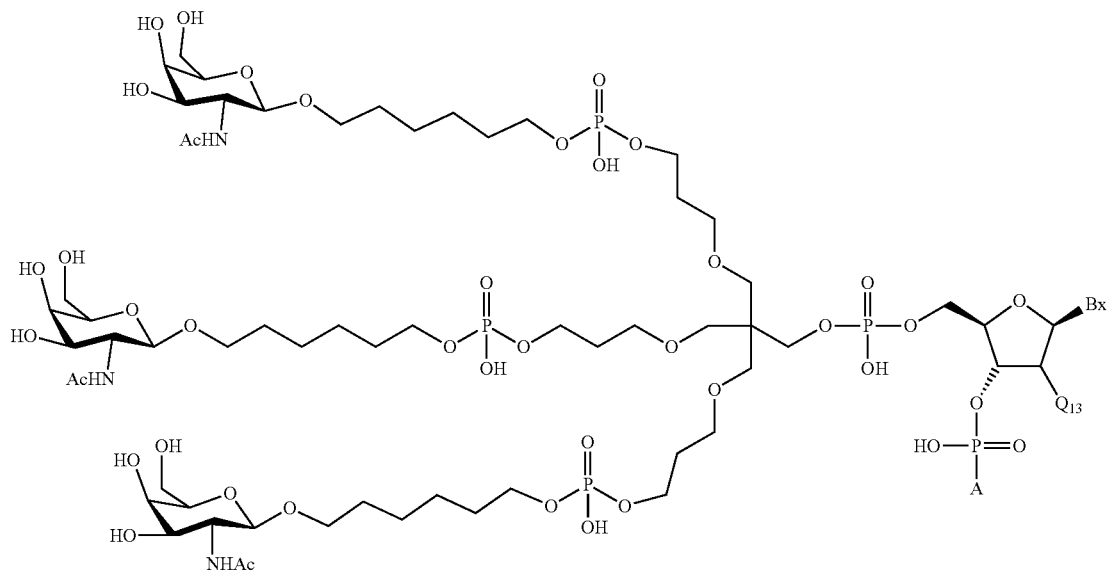

wherein each n is, independently, from 1 to 20;
$Q_{13}$ is H or $O(CH_2)_2$—$OCH_3$;
A is the antisense oligonucleotide; and
Bx is a heterocyclic base moiety.

Embodiment 1219

The conjugated antisense compound of any of claims 1124 to 1131, wherein the conjugate group has the following structure:

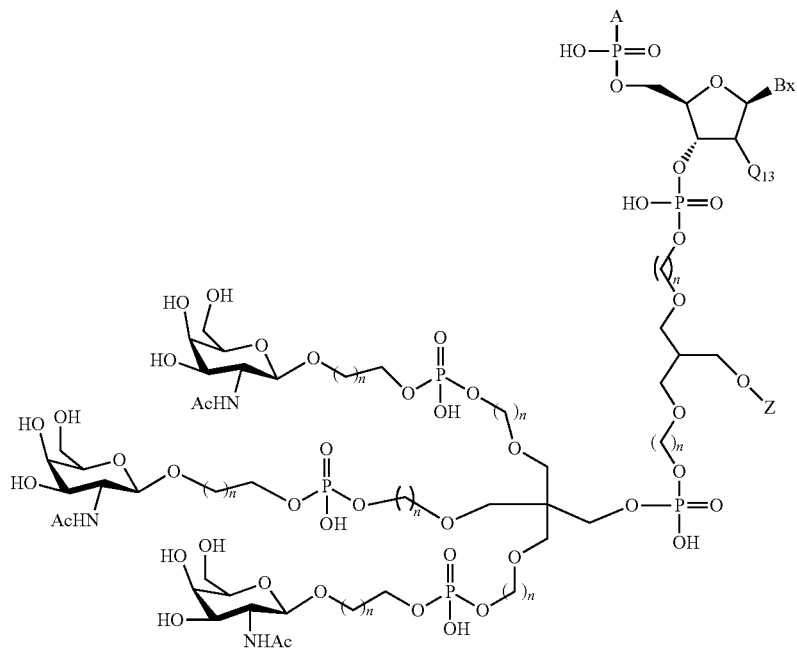

wherein each n is, independently, from 1 to 20;
$Q_{13}$ is H or $O(CH_2)_2$—$OCH_3$;
A is the antisense oligonucleotide;
Z is H or a linked solid support; and
Bx is a heterocyclic base moiety.

Embodiment 1220

The conjugated antisense compound of any of claims 1124 to 1131, wherein the conjugate group has the following structure:

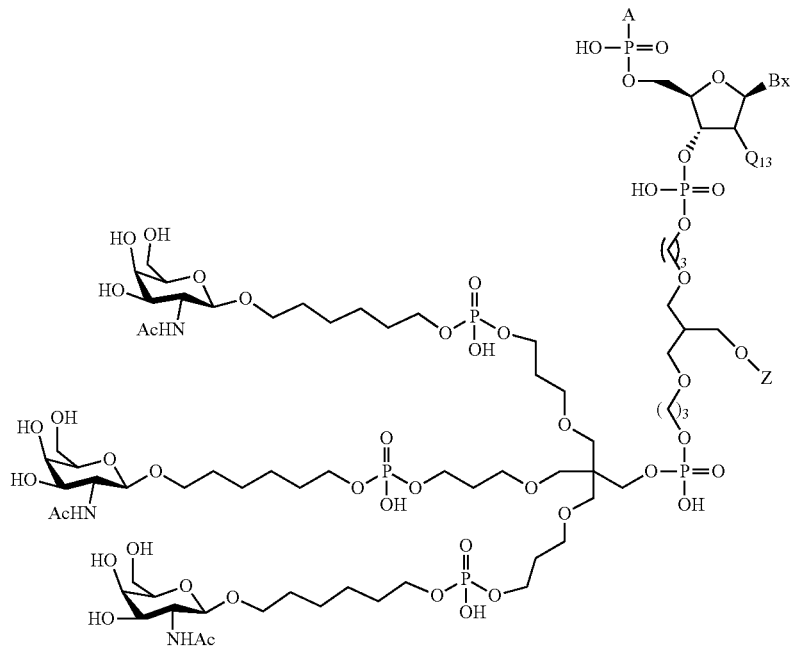

wherein each n is, independently, from 1 to 20;
$Q_{13}$ is H or $O(CH_2)_2$—$OCH_3$;
A is the antisense oligonucleotide;
Z is H or a linked solid support; and
Bx is a heterocyclic base moiety.

Embodiment 1221

The conjugated antisense compound of any of claims 1124 to 1131, wherein the conjugate group has the following structure:

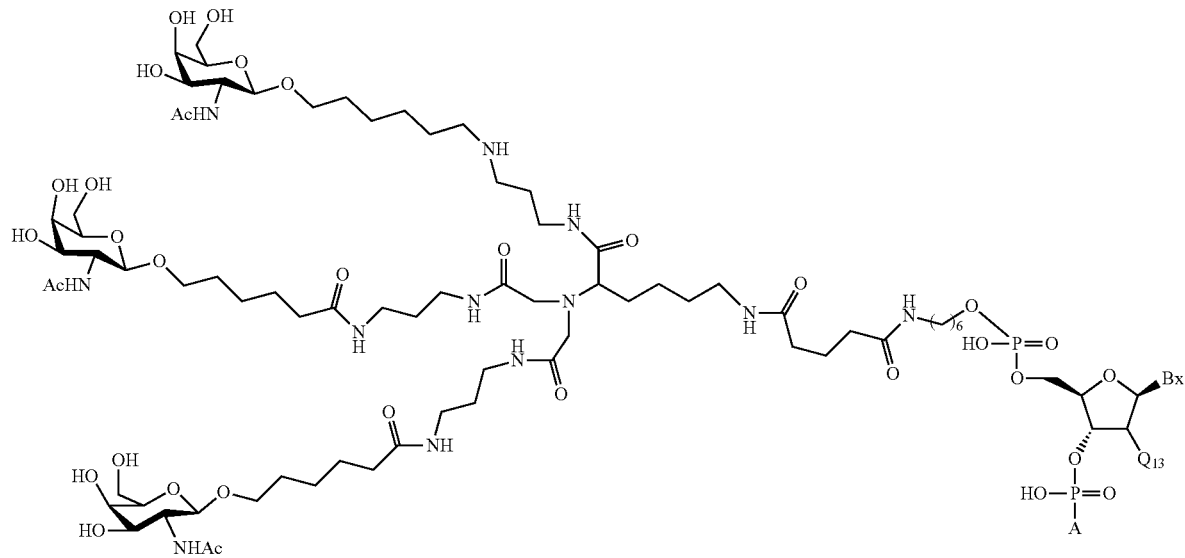

wherein $Q_{13}$ is H or $O(CH_2)_2$—$OCH_3$;
A is the antisense oligonucleotide; and
Bx is a heterocyclic base moiety.

Embodiment 1222

The conjugated antisense compound of any of claims 1124 to 1131, wherein the conjugate group has the following structure:

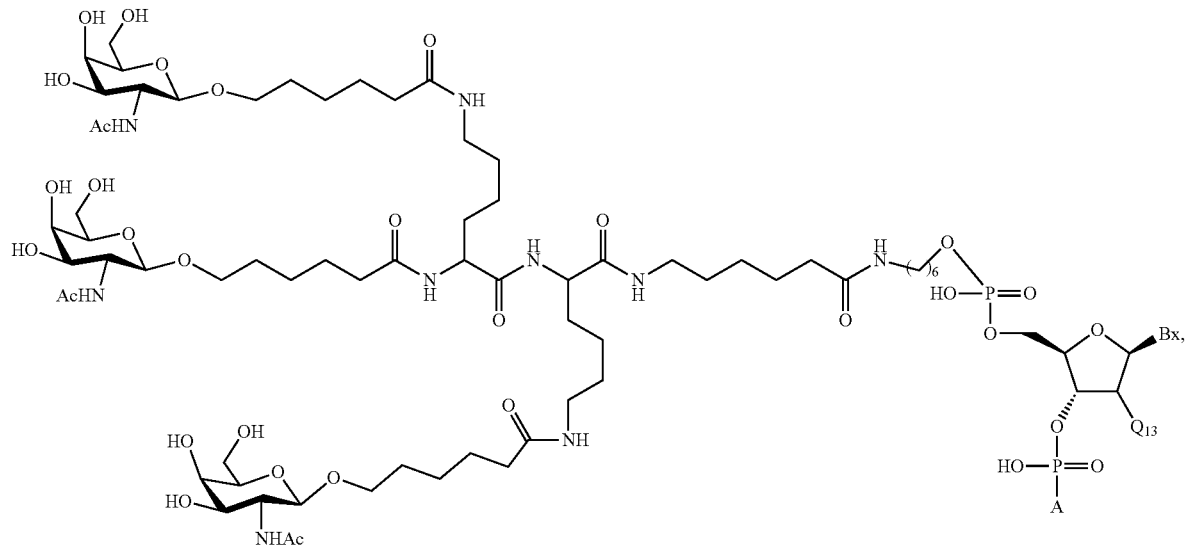

wherein $Q_{13}$ is H or $O(CH_2)_2\text{—}OCH_3$;
A is the antisense oligonucleotide; and
Bx is a heterocyclic base moiety.

Embodiment 1223

The conjugated antisense compound of any of claims 1124 to 1131, wherein the conjugate group has the following structure:

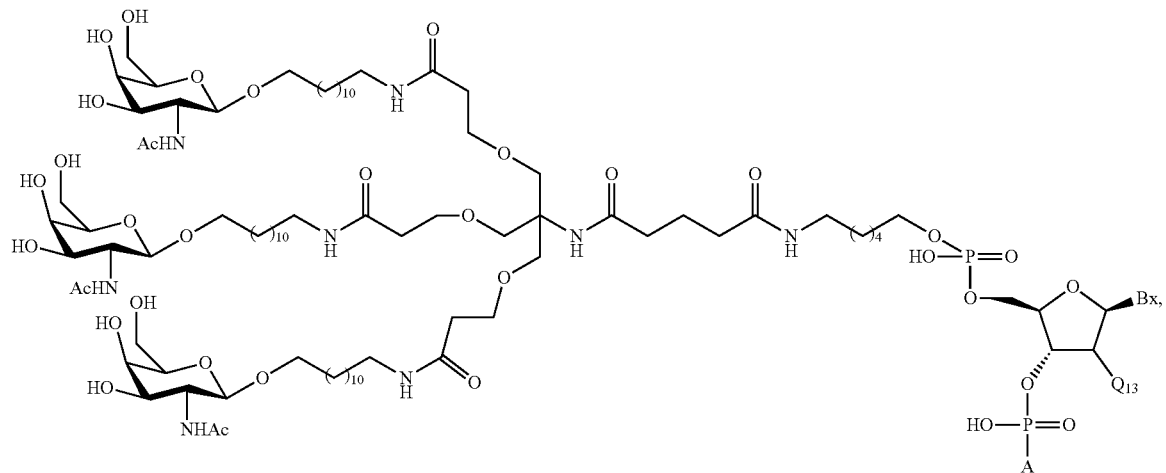

wherein $Q_{13}$ is H or $O(CH_2)_2\text{—}OCH_3$;
A is the antisense oligonucleotide; and
Bx is a heterocyclic base moiety.

Embodiment 1224

The conjugated antisense compound of any of claims 1124 to 1131, wherein the conjugate group has the following structure:

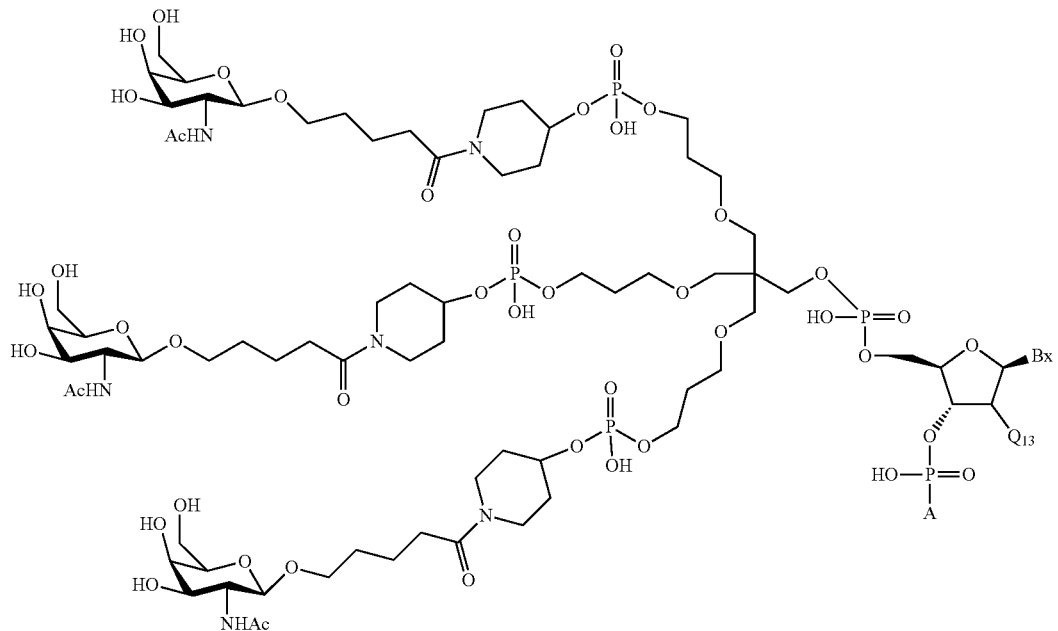

wherein $Q_{13}$ is H or $O(CH_2)_2—OCH_3$;
A is the antisense oligonucleotide; and
Bx is a heterocyclic base moiety.

Embodiment 1225

The conjugated antisense compound of any of claims 1124 to 1131, wherein the conjugate group has the following structure:

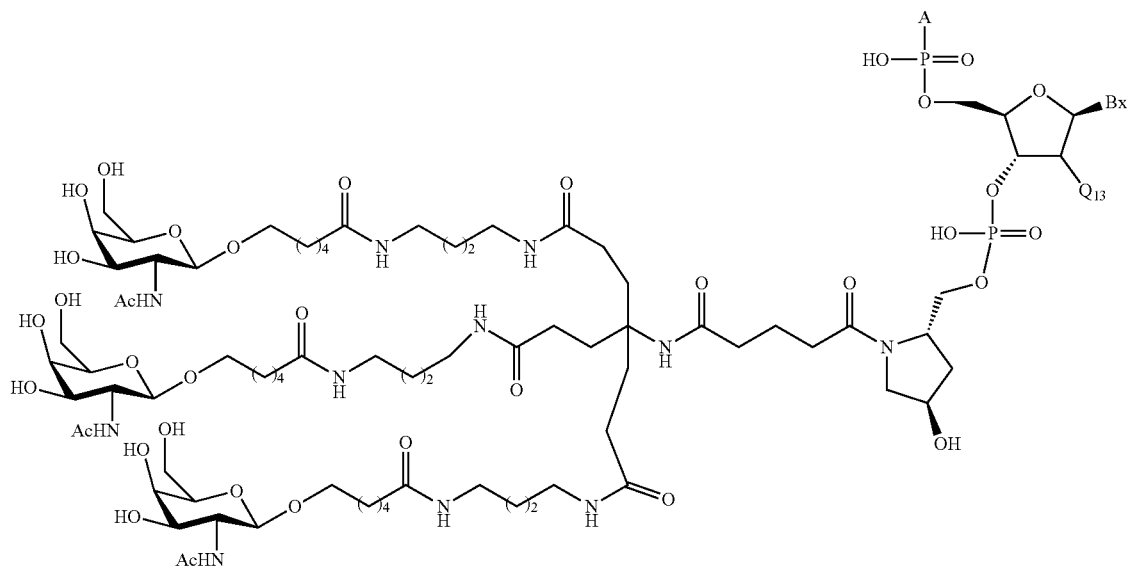

wherein $Q_{13}$ is H or $O(CH_2)_2—OCH_3$;
A is the antisense oligonucleotide; and
Bx is a heterocyclic base moiety.

Embodiment 1226

The conjugated antisense compound of any of claims 1124 to 1131, wherein the conjugate group has the following structure:

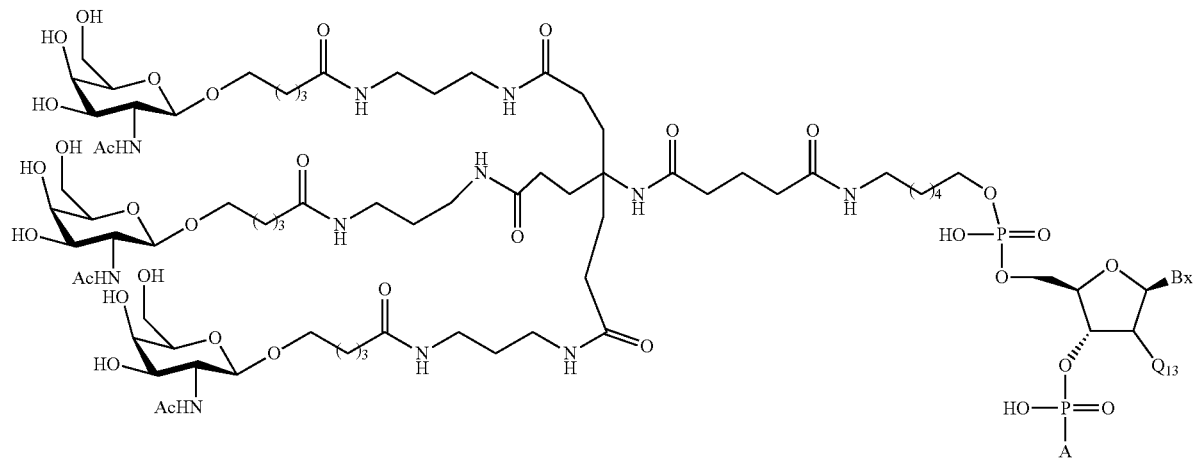

wherein $Q_{13}$ is H or $O(CH_2)_2$—$OCH_3$;
A is the antisense oligonucleotide; and
Bx is a heterocyclic base moiety.

Embodiment 1227

The conjugated antisense compound of any of claims 1124 to 1131, wherein the conjugate group has the following structure:

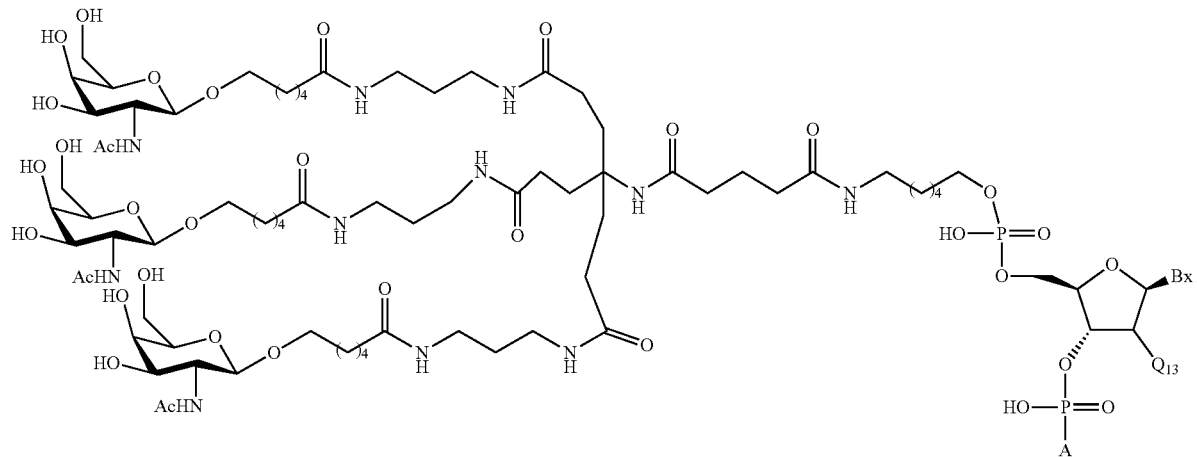

wherein $Q_{13}$ is H or $O(CH_2)_2$—$OCH_3$;
A is the antisense oligonucleotide; and
Bx is a heterocyclic base moiety.

Embodiment 1228

The conjugated antisense compound of any of claims 1124 to 1131, wherein the conjugate group has the following structure:

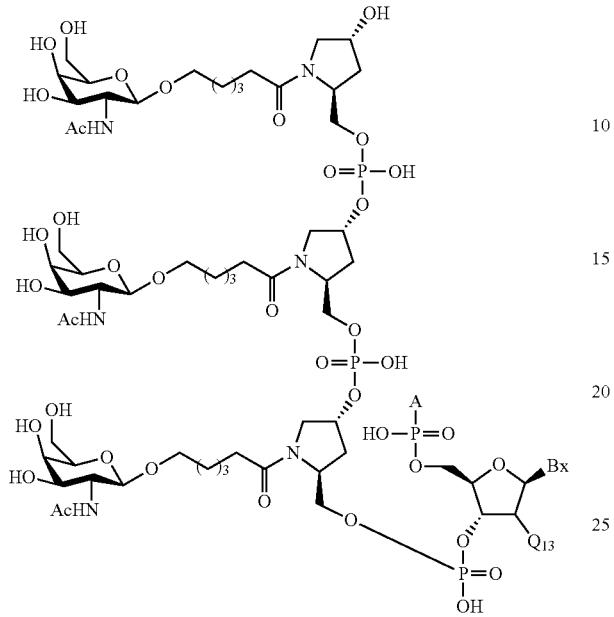

wherein $Q_{13}$ is H or $O(CH_2)_2$—$OCH_3$;
A is the antisense oligonucleotide; and
Bx is a heterocyclic base moiety.

Embodiment 1229

The conjugated antisense compound of any of claims 1124 to 1131, wherein the conjugate group has the following structure:

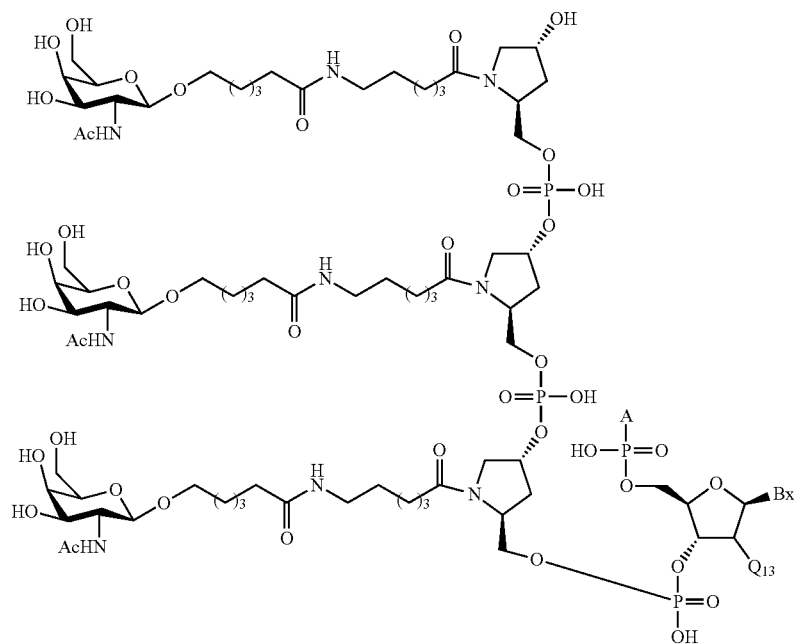

wherein $Q_{13}$ is H or $O(CH_2)_2$—$OCH_3$;
A is the antisense oligonucleotide; and
Bx is a heterocyclic base moiety.

375

Embodiment 1230

The conjugated antisense compound of any of claims 1124 to 1131, wherein the conjugate group has the following structure:

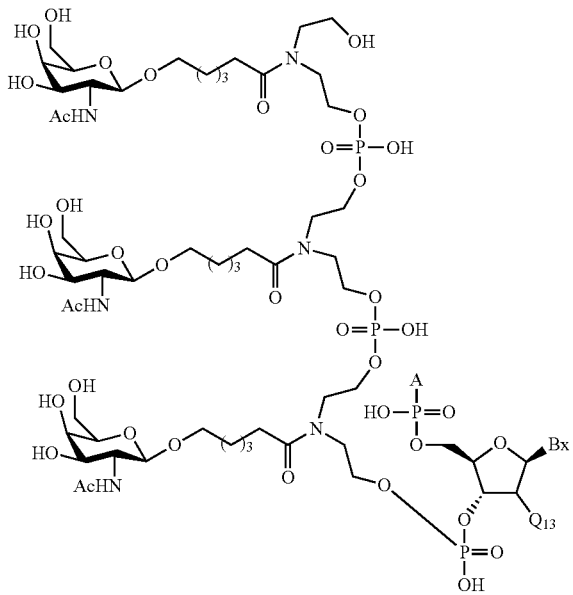

wherein $Q_{13}$ is H or $O(CH_2)_2$—$OCH_3$;
A is the antisense oligonucleotide; and
Bx is a heterocyclic base moiety.

Embodiment 1231

The conjugated antisense compound of any of claims 1124 to 1131, wherein the conjugate group has the following structure:

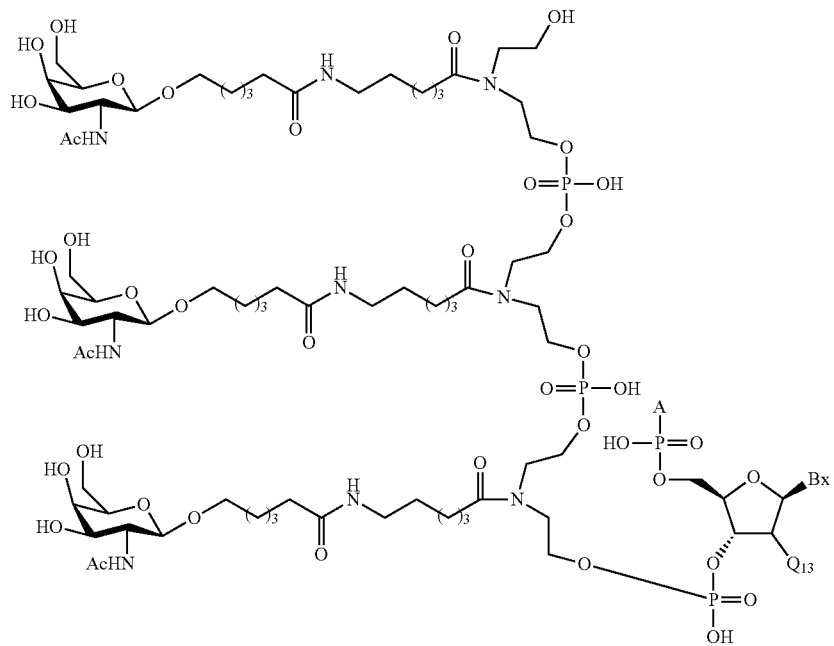

376 wherein $Q_{13}$ is H or $O(CH_2)_2$—$OCH_3$;
A is the antisense oligonucleotide; and
Bx is a heterocyclic base moiety.

Embodiment 1232

The compound of any of claims 1217 to 1231, wherein $B_x$ is selected from among from adenine, guanine, thymine, uracil, or cytosine.

Embodiment 1233

The compound of any of claims 1217 to 1231, wherein $B_x$ is adenine.

Embodiment 1234

The compound of any of claims 1217 to 1231, wherein $B_x$ is thymine

Embodiment 1235

The compound of any of claims 1217 to 1234, wherein $Q_{13}$ is $O(CH_2)_2$—$OCH_3$.

Embodiment 1236

The compound of any of claims 1217 to 1234, wherein $Q_{13}$ is H.

Embodiment 1237

A conjugated oligonucleotide comprising an oligonucleotide and a conjugate group, wherein the conjugate group is any conjugate group of any of claims 1098 to 1236.

Embodiment 1238

The conjugated oligonucleotide of claim 1237 wherein the oligonucleotide comprises at least one modified nucleoside.

Embodiment 1239

The conjugated oligonucleotide of claim 1237 wherein the at least one modified nucleoside comprises a modified base.

Embodiment 1240

The conjugated oligonucleotide of claim 1238 or 1239 wherein the at least one modified nucleoside comprises a sugar surrogate.

Embodiment 1241

The conjugated oligonucleotide of claim 1240 wherein the sugar surrogate is a tetrahydropyran.

Embodiment 1242

The conjugated oligonucleotide of any of claim 1241 wherein the tetrahydropyran is F-HNA.

Embodiment 1243

The conjugated oligonucleotide of any of claims 1238 to 1242 wherein the remainder of the oligonucleotide comprises at least one nucleoside comprising a modified sugar.

Embodiment 1244

The conjugated oligonucleotide of claim 1243 wherein the at least one modified nucleoside comprising a modified sugar is selected from a bicyclic nucleoside and a 2'-modified nucleoside.

Embodiment 1245

The conjugated oligonucleotide of claim 1244 wherein the at least one modified nucleoside is a bicyclic nucleoside.

Embodiment 1246

The conjugated oligonucleotide of claim 1245 wherein the bicyclic nucleoside is a (4'-CH$_2$—O-2') BNA nucleoside.

Embodiment 1247

The conjugated oligonucleotide of claim 1245 wherein the bicyclic nucleoside is a (4'-(CH$_2$)$_2$—O-2') BNA nucleoside.

Embodiment 1248

The conjugated oligonucleotide of claim 1245 wherein the bicyclic nucleoside is a (4'-C(CH$_3$)H—O-2') BNA nucleoside.

Embodiment 1249

The conjugated oligonucleotide of claim 1244 wherein the at least one modified nucleoside is a 2'-modified nucleoside.

Embodiment 1250

The conjugated oligonucleotide of claim 1249 wherein the at least one 2'-modified nucleoside is selected from a 2'-F nucleoside, a 2'-OCH$_3$ nucleoside, and a 2'-O(CH$_2$)$_2$OCH$_3$ nucleoside.

Embodiment 1251

The conjugated oligonucleotide of claim 1250 wherein the at least one 2'-modified nucleoside is a 2'-F nucleoside.

Embodiment 1252

The conjugated oligonucleotide of claim 1250 wherein the at least one 2'-modified nucleoside is a 2'-OCH$_3$ nucleoside.

Embodiment 1253

The conjugated oligonucleotide of claim 1250 wherein the at least one 2'-modified nucleoside is a 2'-O(CH$_2$)$_2$OCH$_3$ nucleoside.

Embodiment 1254

The conjugated oligonucleotide of any of claims 1237-1253 wherein the oligonucleotide comprises at least one unmodified nucleoside.

Embodiment 1255

The conjugated oligonucleotide of claim 1254 wherein the unmodified nucleoside is a ribonucleoside.

Embodiment 1256

The conjugated oligonucleotide of claim 1254 wherein the unmodified nucleoside is a deoxyribonucleoside.

Embodiment 1257

The conjugated oligonucleotide of any of claims 1237 to 1256 wherein the oligonucleotide comprises at least two modified nucleosides.

Embodiment 1258

The conjugated oligonucleotide of claim 1257 wherein the at least two modified nucleosides comprise the same modification.

Embodiment 1259

The conjugated oligonucleotide of claim 1257 wherein the at least two modified nucleosides comprise different modifications.

Embodiment 1260

The conjugated oligonucleotide of any of claims 1257 to 1259 wherein at least one of the at least two modified nucleosides comprises a sugar surrogate.

Embodiment 1261

The conjugated oligonucleotide of any of claims 1257 to 1260 wherein at least one of the at least two modified nucleosides comprises a 2'-modification.

Embodiment 1262

The conjugated oligonucleotide of claim 1261 wherein each of the at least two modified nucleosides is independently selected from 2'-F nucleosides, 2'-OCH$_3$ nucleosides and 2'-O(CH$_2$)$_2$OCH$_3$ nucleosides.

Embodiment 1263

The conjugated oligonucleotide of claim 1262 wherein each of the at least two modified nucleosides is a 2'-F nucleoside.

Embodiment 1264

The conjugated oligonucleotide of claim 1262 wherein each of the at least two modified nucleosides is a 2'-OCH$_3$ nucleosides.

Embodiment 1265

The conjugated oligonucleotide of claim 1262 wherein each of the at least two modified nucleosides is a 2'-O(CH$_2$)$_2$OCH$_3$ nucleoside.

Embodiment 1266

The conjugated oligonucleotide of any of claims 1237 to 1265 wherein essentially every nucleoside of the oligonucleotide is a modified nucleoside.

Embodiment 1267

The conjugated oligonucleotide of any of claims 1237 to 1257 or 1260 to 1266 wherein every nucleoside of the oligonucleotide is a modified nucleoside.

Embodiment 1268

The conjugated oligonucleotide of any of claims 1237 to 1267 wherein the oligonucleotide is single-stranded.

Embodiment 1269

The conjugated oligonucleotide of any of claims 1237 to 1267 wherein the oligonucleotide is double-stranded.

Embodiment 1270

The conjugated oligonucleotide of any of claims 1237 to 1267, wherein the oligonucleotide is an antisense compound.

Embodiment 1271

The conjugated oligonucleotide of any of claims 1237 to 1267, wherein the oligonucleotide is a RISC based oligonucleotide.

Embodiment 1272

The conjugated oligonucleotide of any of claims 1237 to 1267, wherein the oligonucleotide activates the RISC pathway.

Embodiment 1273

The conjugated oligonucleotide of any of claims 1237 to 1267, wherein the oligonucleotide is an RNase H based antisense compound.

Embodiment 1274

The conjugated oligonucleotide compound of any of claims 1237 to 1273, wherein the conjugate group is attached to the 5'-terminal nucleoside of the antisense oligonucleotide.

Embodiment 1275

The conjugated oligonucleotide compound of any of claims 1237 to 1273, wherein the conjugate group is attached to the 3'-terminal nucleoside of the antisense oligonucleotide.

Embodiment 1276

The conjugated oligonucleotide compound of any of claims 1237 to 1273, wherein the conjugate group is attached to an internal nucleoside of the antisense oligonucleotide.

Embodiment 1277

The conjugated oligonucleotide compound of any of claims 1237 to 1273, wherein the conjugate group increases uptake of the conjugated oligonucleotide compound into a hepatocyte relative to an unconjugated oligonucleotide compound.

Embodiment 1278

The conjugated oligonucleotide compound of any of claims 1237 to 1273, wherein the conjugate group increases the uptake of the conjugated oligonucleotide compound into a liver cell relative to an unconjugated oligonucleotide compound.

Embodiment 1279

The conjugated oligonucleotide compound of any of claims 1237 to 1273, wherein the conjugate group increases accumulation of the conjugated oligonucleotide compound in the liver relative to an unconjugated oligonucleotide compound.

Embodiment 1280

The conjugated oligonucleotide compound of any of claims 1237 to 1273, wherein the conjugate group decreases accumulation of the conjugated oligonucleotide compound in the kidneys relative to an unconjugated oligonucleotide compound.

Embodiment 1281

The conjugated oligonucleotide compound of claims 1237 to 1265 or 1268 to 1280, wherein the conjugated oligonucleotide has a sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 1282

The conjugated oligonucleotide compound of claim 1281, wherein the 5'-region consists of 2 linked 5'-region nucleosides.

Embodiment 1283

The conjugated oligonucleotide compound of claim 1281, wherein the 5'-region consists of 3 linked 5'-region nucleosides.

Embodiment 1284

The conjugated oligonucleotide compound of claim 1281, wherein the 5'-region consists of 4 linked 5'-region nucleosides.

Embodiment 1285

The conjugated oligonucleotide compound of claim 1281, wherein the 5'-region consists of 5 linked 5'-region nucleosides.

Embodiment 1286

The conjugated oligonucleotide compound of any of claims 1281-1285, wherein the 3'-region consists of 2 linked 3'-region nucleosides.

Embodiment 1287

The conjugated oligonucleotide compound of any of claims 1281-1285, wherein the 3'-region consists of 3 linked 3'-region nucleosides.

Embodiment 1288

The conjugated oligonucleotide compound of any of claims 1281-1285, wherein the 3'-region consists of 4 linked 3'-region nucleosides.

Embodiment 1289

The conjugated oligonucleotide compound of any of claims 1281-1285, wherein the 3'-region consists of 5 linked 3'-region nucleosides.

Embodiment 1290

The conjugated oligonucleotide compound of any of claims 1281-1289, wherein the central region consists of 5 linked central region nucleosides.

Embodiment 1291

The conjugated oligonucleotide compound of any of claims 1281-1289, wherein the central region consists of 6 linked central region nucleosides.

Embodiment 1292

The conjugated oligonucleotide compound of any of claims 1281-1289, wherein the central region consists of 7 linked central region nucleosides.

Embodiment 1293

The conjugated oligonucleotide compound of any of claims 1281-1289, wherein the central region consists of 8 linked central region nucleosides.

Embodiment 1294

The conjugated oligonucleotide compound of any of claims 1281-1289, wherein the central region consists of 9 linked central region nucleosides.

Embodiment 1295

The conjugated oligonucleotide compound of any of claims 1281-1289, wherein the central region consists of 10 linked central region nucleosides.

Embodiment 1296

The conjugated oligonucleotide compound of any of claims 1281-1295, wherein the conjugated oligonucleotide consists of 14 to 26 linked nucleosides.

Embodiment 1297

The conjugated oligonucleotide compound of any of claims 1281-1295, wherein the conjugated oligonucleotide consists of 15 to 25 linked nucleosides.

Embodiment 1298

The conjugated oligonucleotide compound of any of claims 1281-1295, wherein the conjugated oligonucleotide consists of 16 to 20 linked nucleosides.

Embodiment 1299

The conjugated oligonucleotide compound of any of claims 1281-1298, wherein each modified nucleoside independently comprises a 2'-substituted sugar moiety or a bicyclic sugar moiety.

Embodiment 1300

The conjugated oligonucleotide compound of claim 1299, wherein the at least one modified nucleoside comprises a 2'-substituted sugar moiety.

Embodiment 1301

The conjugated oligonucleotide compound of claim 1300, wherein each modified nucleoside comprising a 2'-substituted sugar moiety comprises a 2' substituent independently selected from among: halogen, optionally substituted allyl, optionally substituted amino, azido, optionally substituted SH, CN, OCN, CF3, OCF3, O, S, or N(Rm)-alkyl; O, S, or N(Rm)-alkenyl; O, S or N(Rm)-alkynyl; optionally substituted O-alkylenyl-O-alkyl, optionally substituted alkynyl, optionally substituted alkaryl, optionally substituted aralkyl, optionally substituted O-alkaryl, optionally substituted O-aralkyl, O(CH2)2SCH3, O—(CH2)2-O—N(Rm)(Rn) or O—CH2-C(=O)—N(Rm)(Rn), where each Rm and Rn is, independently, H, an amino protecting group or substituted or unsubstituted $C_1$-$C_{10}$ alkyl;
wherein each optionally substituted group is optionally substituted with a substituent group independently selected from among: hydroxyl, amino, alkoxy, carboxy, benzyl, phenyl, nitro ($NO_2$), thiol, thioalkoxy (S-alkyl), halogen, alkyl, aryl, alkenyl and alkynyl.

Embodiment 1302

The conjugated oligonucleotide compound of claim 1300, wherein each 2' substituent is independently selected from among: a halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—CH=$CH_2$, $O(CH_2)_2$—$OCH_3$, $O(CH_2)_2$—$SCH_3$, $O(CH_2)_2$—$OCF_3$, $O(CH_2)_3$—$N(R_1)(R_2)$, $O(CH_2)_2$—$ON(R_1)(R_2)$, $O(CH_2)_2$—$O(CH_2)_2$—$N(R_1)(R_2)$, $OCH_2C(=O)$—$N(R_1)(R_2)$, $OCH_2C(=O)$—$N(R_3)$—$(CH_2)_2$—$N(R_1)(R_2)$, and $O(CH_2)_2$—$N(R_3)$—$C(=NR_4)[N(R_1)(R_2)]$; wherein $R_1$, $R_2$, $R_3$ and $R_4$ are each, independently, H or $C_1$-$C_6$ alkyl.

Embodiment 1303

The conjugated oligonucleotide compound of claim 1300, wherein each 2' substituent is independently selected from among: a halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$.

Embodiment 1304

The conjugated oligonucleotide compound of claim 1300, wherein the at least one 2'-modified nucleoside comprises a 2'-MOE sugar moiety.

Embodiment 1305

The conjugated oligonucleotide compound of claim 1300, wherein the at least one 2'-modified nucleoside comprises a 2'-OMe sugar moiety.

Embodiment 1306

The conjugated oligonucleotide compound of claim 1300, wherein the at least one 2'-modified nucleoside comprises a 2'-F sugar moiety.

Embodiment 1307

The conjugated oligonucleotide compound of any of claims 1281-1298, wherein the conjugated oligonucleotide comprises at least one modified nucleoside comprising a sugar surrogate.

Embodiment 1308

The conjugated oligonucleotide compound of claim 1307, wherein the modified nucleoside comprises an F-HNA sugar moiety.

Embodiment 1309

The conjugated oligonucleotide compound of claim 1307, wherein the modified nucleoside comprises an HNA sugar moiety.

Embodiment 1310

The conjugated oligonucleotide compound of any of claims 1281-1298 wherein the conjugated oligonucleotide comprises at least one modified nucleoside comprising a bicyclic sugar moiety.

Embodiment 1311

The conjugated oligonucleotide compound of claim 1310, wherein the bicyclic sugar moiety is a cEt sugar moiety.

Embodiment 1312

The conjugated oligonucleotide compound of claim 1310, wherein bicyclic sugar moiety is an LNA sugar moiety.

Embodiment 1313

The conjugated oligonucleotide compound of any of claims 1237 to 1312, wherein the conjugated oligonucleotide comprises at least one modified internucleoside linkage.

Embodiment 1314

The conjugated oligonucleotide compound of claim 1238, wherein each internucleoside linkage of the conjugated oligonucleotide is a modified internucleoside linkage.

Embodiment 1315

The conjugated oligonucleotide compound of claim 1313, wherein the conjugated oligonucleotide comprises at least one modified linkage and at least one unmodified phosphodiester internucleoside linkage.

Embodiment 1316

The conjugated oligonucleotide compound of any of claim 1313 or 1315 wherein at least one modified internucleoside linkage is a phosphorothioate internucleoside linkage.

Embodiment 1317

The conjugated oligonucleotide compound of any of claim 1313 or 1315, wherein each modified internucleoside linkage is a phosphorothioate internucleoside linkage.

Embodiment 1318

The conjugated oligonucleotide compound of any of claim 1313 or 1314, wherein the conjugated oligonucleotide comprises at least 2 phosphodiester internucleoside linkages.

Embodiment 1319

The conjugated oligonucleotide compound of any of claim 1313 or 1314, wherein the conjugated oligonucleotide comprises at least 3 phosphodiester internucleoside linkages.

Embodiment 1320

The conjugated oligonucleotide compound of any of claim 1313 or 1314, wherein the conjugated oligonucleotide comprises at least 4 phosphodiester internucleoside linkages.

Embodiment 1321

The conjugated oligonucleotide compound of any of claim 1313 or 1314, wherein the conjugated oligonucleotide comprises at least 5 phosphodiester internucleoside linkages.

Embodiment 1322

The conjugated oligonucleotide compound of any of claim 1313 or 1314, wherein the conjugated oligonucleotide comprises at least 6 phosphodiester internucleoside linkages.

Embodiment 1323

The conjugated oligonucleotide compound of any of claim 1313 or 1314, wherein the conjugated oligonucleotide comprises at least 7 phosphodiester internucleoside linkages.

Embodiment 1324

The conjugated oligonucleotide compound of any of claim 1313 or 1314, wherein the conjugated oligonucleotide comprises at least 8 phosphodiester internucleoside linkages.

Embodiment 1325

The conjugated oligonucleotide compound of any of claim 1313 or 1314, wherein the conjugated oligonucleotide comprises at least 9 phosphodiester internucleoside linkages.

Embodiment 1326

The conjugated oligonucleotide compound of any of claim 1313 or 1314, wherein the conjugated oligonucleotide comprises at least 10 phosphodiester internucleoside linkages.

Embodiment 1327

The conjugated oligonucleotide compound of any of claims 1313 or 1315 to 1326, wherein the conjugated oligonucleotide comprises fewer than 16 phosphorothioate internucleoside linkages.

Embodiment 1328

The conjugated oligonucleotide compound of any of claims 1313 or 1315 to 1326, wherein the conjugated oligonucleotide comprises fewer than 15 phosphorothioate internucleoside linkages.

Embodiment 1329

The conjugated oligonucleotide compound of any of claims 1313 or 1315 to 1326, wherein the conjugated oligonucleotide comprises fewer than 14 phosphorothioate internucleoside linkages.

Embodiment 1330

The conjugated oligonucleotide compound of any of claims 1313 or 1315 to 1326, wherein the conjugated oligonucleotide comprises fewer than 13 phosphorothioate internucleoside linkages.

Embodiment 1331

The conjugated oligonucleotide compound of any of claims 1313 or 1315 to 1326, wherein the conjugated oligonucleotide comprises fewer than 12 phosphorothioate internucleoside linkages.

Embodiment 1332

The conjugated oligonucleotide compound of any of claims 1313 or 1315 to 1326, wherein the conjugated oligonucleotide comprises fewer than 11 phosphorothioate internucleoside linkages.

Embodiment 1333

The conjugated oligonucleotide compound of any of claims 1313 or 1315 to 1326, wherein the conjugated oligonucleotide comprises fewer than 10 phosphorothioate internucleoside linkages.

Embodiment 1334

The conjugated oligonucleotide compound of any of claims 1313 or 1315 to 1326, wherein the conjugated oligonucleotide comprises fewer than 9 phosphorothioate internucleoside linkages.

Embodiment 1335

The conjugated oligonucleotide compound of any of claims 1313 or 1315 to 1326, wherein the conjugated oligonucleotide comprises fewer than 8 phosphorothioate internucleoside linkages.

Embodiment 1336

The conjugated oligonucleotide compound of any of claims 1313 or 1315 to 1326, wherein the conjugated oligonucleotide comprises fewer than 7 phosphorothioate internucleoside linkages.

Embodiment 1337

The conjugated oligonucleotide compound of any of claims 1313 or 1315 to 1326, wherein the conjugated oligonucleotide comprises fewer than 6 phosphorothioate internucleoside linkages.

Embodiment 1338

The conjugated oligonucleotide compound of any of claims 1237 to 1337, wherein each terminal internucleoside linkage of the conjugated oligonucleotide is a phosphorothioate internucleoside linkage.

Embodiment 1339

The conjugated oligonucleotide compound of any of claims 1237 to 1314 or 1327 to 1338, wherein each internucleoside linkage linking two deoxynucleosides of the conjugated oligonucleotide is a phosphorothioate internucleoside linkage.

Embodiment 1340

The conjugated oligonucleotide compound of any of claims 1237 to 1314 or 1327 to 1339, wherein each non-terminal internucleoside linkage linking two modified nucleosides of the conjugated oligonucleotide is a phosphodiester internucleoside linkage.

Embodiment 1341

The conjugated oligonucleotide compound of any of claims 1237 to 1314 or 1327 to 1340, wherein each non-terminal internucleoside linkage of the conjugated oligonucleotide that is 3' of a modified nucleoside is a phosphodiester internucleoside linkage.

Embodiment 1342

The conjugated oligonucleotide compound of any of claims 1237 to 1314 or 1327 to 1341, wherein each internucleoside linkage of the conjugated oligonucleotide that is 3' of a deoxynucleoside is a phosphorothioate internucleoside linkage.

Embodiment 1343

The conjugated oligonucleotide compound of any of claims 1237 to 1314 or 1327 to 1342 wherein the conjugated oligonucleotide has a chemical motif selected from among:
MsMy(Ds)$_{0-1}$(DsDs)$_{(3-5)}$MsM
MsMy(Ds)$_{0-1}$(DsDs)$_{(3-5)}$MyMsM
MsMy(Ds)$_{0-1}$(DsDs)$_{(3-5)}$MyMyMsM
MsMy(Ds)$_{0-1}$(DsDs)$_{(3-5)}$MyMyMyMsM
MsMyMy(Ds)$_{0-1}$(DsDs)$_{(3-5)}$MsM
MsMyMy(Ds)$_{0-1}$(DsDs)$_{(3-5)}$MyMsM
MsMyMy(Ds)$_{0-1}$(DsDs)$_{(3-5)}$MyMyMsM
MsMyMy(Ds)$_{0-1}$(DsDs)$_{(3-5)}$MyMyMyMsM
MsMyMyMy(Ds)$_{0-1}$(DsDs)$_{(3-5)}$MsM
MsMyMyMy(Ds)$_{0-1}$(DsDs)$_{(3-5)}$MyMsM
MsMyMyMy(Ds)$_{0-1}$(DsDs)$_{(3-5)}$MyMyMsM
MsMyMyMyMy(Ds)$_{0-1}$(DsDs)$_{(3-5)}$MsM
MsMyMyMyMy(Ds)$_{0-1}$(DsDs)$_{(3-5)}$MyMsM
MsMyMyMyMy(Ds)$_{0-1}$(DsDs)$_{(3-5)}$MyMyMsM; and
MsMyMyMyMy(Ds)$_{0-1}$(DsDs)$_{(3-5)}$MyMyMyMsM;
wherein each M is independently a modified nucleoside, each D is a deoxynucleoside; each s is a phosphorothioate internucleoside linkage, and each y is either a phosphodiester internucleoside linkage or a phosphorothioate internucleoside linkage, provided that at least one y is a phosphodiester internucleotide linkage.

Embodiment 1344

The conjugated oligonucleotide compound of any of claims 1237 to 1314 or 1327 to 1342, wherein the conjugated oligonucleotides has a chemical motif selected from among:
MsMo(Ds)$_{0-1}$(DsDs)$_{(3-5)}$MoMsM
MsMo(Ds)$_{0-1}$(DsDs)$_{(3-5)}$MoMoMsM
MsMo(Ds)$_{0-1}$(DsDs)$_{(3-5)}$MoMoMoMsM
MsMoMo(Ds)$_{0-1}$(DsDs)$_{(3-5)}$MsM
MsMoMo(Ds)$_{0-1}$(DsDs)$_{(3-5)}$MoMsM
MsMoMo(Ds)$_{0-1}$(DsDs)$_{(3-5)}$MoMoMsM
MsMoMo(Ds)$_{0-1}$(DsDs)$_{(3-5)}$MoMoMoMsM
MsMoMoMo(Ds)$_{0-1}$(DsDs)$_{(3-5)}$MsM
MsMoMoMo(Ds)$_{0-1}$(DsDs)$_{(3-5)}$MoMsM
MsMoMoMo(Ds)$_{0-1}$(DsDs)$_{(3-5)}$MoMoMsM
MsMoMoMo(Ds)$_{0-1}$(DsDs)$_{(3-5)}$MoMoMoMsM
MsMoMoMoMo(Ds)$_{0-1}$(DsDs)$_{(3-5)}$MsM
MsMoMoMoMo(Ds)$_{0-1}$(DsDs)$_{(3-5)}$MoMsM
MsMoMoMoMo(Ds)$_{0-1}$(DsDs)$_{(3-5)}$MoMoMsM; and
MsMoMoMoMo(Ds)$_{0-1}$(DsDs)$_{(3-5)}$MoMoMoMsM;
wherein each M is independently a modified nucleoside, each D is a deoxynucleoside; each o is a phosphodiester internucleoside linkage, and each s is a phosphorothioate internucleoside linkage.

Embodiment 1345

The conjugated oligonucleotide compound of claim 1343 or 1344, wherein each M is independently selected from among: a 2'-MOE nucleoside and a bicyclic nucleoside.

Embodiment 1346

The conjugated oligonucleotide compound of claim 1345, wherein each M is independently selected from among a 2'-MOE nucleoside, a cEt nucleoside, and an LNA nucleoside.

Embodiment 1347

The conjugated oligonucleotide compound of claim 1345 or 1346, wherein each M is a 2'-MOE nucleoside.

Embodiment 1348

The conjugated oligonucleotide compound of claim 1345 or 1346, wherein each M is a cEt nucleoside.

389

Embodiment 1349

The conjugated oligonucleotide compound of claim 1345 or 1346, wherein each M is an LNA nucleoside.

Embodiment 1350

The conjugated oligonucleotide compound of any of claims 1237 to 1349, wherein the conjugated oligonucleotide has a nucleobase sequence comprising an at least 8 nucleobase portion complementary to an equal length portion of a target nucleic acid.

Embodiment 1351

The conjugated oligonucleotide compound of any of claims 1237 to 1349, wherein the conjugated oligonucleotide has a nucleobase sequence comprising an at least 10 nucleobase portion complementary to an equal length portion of a target nucleic acid.

Embodiment 1352

The conjugated oligonucleotide compound of any of claims 1237 to 1349, wherein the conjugated oligonucleotide has a nucleobase sequence comprising an at least 12 nucleobase portion complementary to an equal length portion of a target nucleic acid.

Embodiment 1353

The conjugated oligonucleotide compound of any of claims 1237 to 1349, wherein the conjugated oligonucleotide has a nucleobase sequence comprising an at least 14 nucleobase portion complementary to an equal length portion of a target nucleic acid.

Embodiment 1354

The conjugated oligonucleotide compound of any of claims 1237 to 1349, wherein the conjugated oligonucleotide has a nucleobase sequence comprising an at least 16 nucleobase portion complementary to an equal length portion of a target nucleic acid.

Embodiment 1355

The conjugated oligonucleotide compound of any of claims 1237 to 1349, wherein the conjugated oligonucleotide has a nucleobase sequence comprising an at least 18 nucleobase portion complementary to an equal length portion of a target nucleic acid.

Embodiment 1356

The conjugated oligonucleotide compound of any of claims 1237 to 1349, wherein the conjugated oligonucleotide is at least 90% complementary to a target nucleic acid.

Embodiment 1357

The conjugated oligonucleotide compound of any of claims 1237 to 1349, wherein the conjugated oligonucleotide is at least 95% complementary to a target nucleic acid.

390

Embodiment 1358

The conjugated oligonucleotide compound of any of claims 1237 to 1349, wherein the conjugated oligonucleotide is 100% complementary to a target nucleic acid.

Embodiment 1359

The conjugated oligonucleotide compound of any of claims 1350 to 1358, wherein the target nucleic acid is a pre-mRNA.

Embodiment 1360

The conjugated oligonucleotide compound of any of claims 1350 to 1358, wherein the target nucleic acid is an mRNA.

Embodiment 1361

The conjugated oligonucleotide compound of any of claims 1350 to 1358, wherein the target nucleic acid is a micro RNA.

Embodiment 1362

The conjugated oligonucleotide compound of any of claims 1350 to 1358, wherein the target nucleic acid is expressed in the liver.

Embodiment 1363

The conjugated oligonucleotide compound of any of claims 1350 to 1358, wherein the target nucleic acid is expressed in hepatocytes.

Embodiment 1364

The conjugated oligonucleotide compound of any of claims 1350 to 1360, wherein the target nucleic encodes a protein selected from among: Alpha 1 antitrypsin, Androgen Receptor, Apolipoprotein (a), Apolipoprotein B, Apolipoprotein C-III, C-Reactive Protein, eIF-4E, Factor VII, Factor XI, Glucocorticoid Receptor, Glucagon Receptor, Protein Tyrosine Phosphatase 1B, STAT3, SRB-1, and Transthyretin.

Embodiment 1365

The conjugated oligonucleotide compound of any of claims 1350 to 1361 wherein the target nucleic acid is a viral nucleic acid.

Embodiment 1366

The conjugated oligonucleotide compound of claim 1365, wherein the viral nucleic acid expressed in the liver.

Embodiment 1367

The conjugated oligonucleotide compound of claim 1366, wherein the target nucleic acid is a Hepatitis B viral nucleic acid.

Embodiment 1368

The conjugated oligonucleotide compound of any of claims 1237 to 1360, wherein the conjugated oligonucleotide comprises the nucleobase sequence of any one of SEQ ID NOs.: 17, 18, 19, 20, 21, 22, 23, or 24.

Embodiment 1369

The conjugated oligonucleotide compound of any of claims 1237 to 1360, wherein the conjugated oligonucleotide comprises the nucleobase sequence of any one of SEQ ID NO.: 25, 26, 27, 28, 29, or 30.

Embodiment 1370

The conjugated oligonucleotide compound of any of claims 1237 to 1360, wherein the conjugated oligonucleotide comprises the nucleobase sequence of SEQ ID NO.: 31.

Embodiment 1371

The conjugated oligonucleotide compound of any of claims 1237 to 1360, wherein the conjugated oligonucleotide comprises the nucleobase sequence of SEQ ID NO.: 32.

Embodiment 1372

The conjugated oligonucleotide compound of any of claims 1237 to 1360, wherein the conjugated oligonucleotide comprises the nucleobase sequence of SEQ ID NO.: 33.

Embodiment 1373

The conjugated oligonucleotide compound of any of claims 1237 to 1360, wherein the conjugated oligonucleotide comprises the nucleobase sequence of SEQ ID NO.: 34.

Embodiment 1374

The conjugated oligonucleotide compound of any of claims 1237 to 1360, wherein the conjugated oligonucleotide comprises the nucleobase sequence of any of SEQ ID NOs.: 35, 36, 37, 38, 39, 40, 41, 42, or 43.

Embodiment 1375

The conjugated oligonucleotide compound of any of claims 1237 to 1360, wherein the conjugated oligonucleotide comprises the nucleobase sequence of SEQ ID NO.: 44, 45, 46, 47, or 48.

Embodiment 1376

The conjugated oligonucleotide compound of any of claims 1237 to 1360, wherein the conjugated oligonucleotide comprises the nucleobase sequence of any of SEQ ID NOs.: 49, 50, 51, 52, 53, 54, 55, 56, 57, 58, or 59.

Embodiment 1377

The conjugated oligonucleotide compound of any of claims 1237 to 1360, wherein the conjugated oligonucleotide comprises the nucleobase sequence of any of SEQ ID NOs.: 60, 61, 62, 63, 64, 65, 66, or 67.

Embodiment 1378

The conjugated oligonucleotide compound of any of claims 1237 to 1360, wherein the conjugated oligonucleotide comprises the nucleobase sequence of any of SEQ ID NO.: 69, 70, 71, or 72.

Embodiment 1379

The conjugated oligonucleotide compound of any of claims 1237 to 1360, wherein the conjugated oligonucleotide comprises the nucleobase sequence of SEQ ID NO.: 73.

Embodiment 1380

The conjugated oligonucleotide compound of any of claims 1237 to 1360, wherein the conjugated oligonucleotide comprises the nucleobase sequence of any of SEQ ID NOs.: 74, 75, 76, 77, 78, 79, 80, or 81.

Embodiment 1381

The conjugated oligonucleotide compound of any of claims 1237 to 1360, wherein the conjugated oligonucleotide comprises the nucleobase sequence of SEQ ID NO.: 68.

Embodiment 1382

The conjugated oligonucleotide compound of any of claims 1237 to 1360, wherein the conjugated oligonucleotide comprises the nucleobase sequence of any of SEQ ID NOs.: 82-103, 111, or 113.

Embodiment 1383

The conjugated oligonucleotide compound of any of claims 1237 to 1382, wherein the conjugated oligonucleotide is an antisense oligonucleotide.

Embodiment 1384

A pharmaceutical composition comprising a compound or conjugated oligonucleotide according to any of claims 1098 to 1383 and a pharmaceutically acceptable carrier or diluent.

Embodiment 1385

The pharmaceutical composition of claim 1384 wherein the pharmaceutically acceptable carrier or diluent is selected from among sterile water and sterile saline.

Embodiment 1386

A method of reducing the amount or activity of a target nucleic acid in a cell, comprising contacting a cell with a compound or conjugated antisense compound of any of claims 1098 to 1383, or the pharmaceutical composition of claims 1384 to 1385.

Embodiment 1387

The method of claim 1386, wherein the cell is a liver cell.

Embodiment 1388

The method of claim 1386, wherein the cell is a hepatocyte.

Embodiment 1389

The method of any of claims 1386 to 1388 wherein the cell is in vitro.

Embodiment 1390

The method of any of claims 1386 to 1388, wherein the cell is in an animal.

Embodiment 1391

The method of claim 1060 wherein the animal is a mouse.

Embodiment 1392

The method of claim 1060 wherein the animal is a human.

Embodiment 1393

A method of treating a disease or condition in an animal comprising administering the pharmaceutical composition of claim 1384 or 1386 to the animal and thereby treating the disease or condition in the animal.

Embodiment 1394

The method of claim 1393 wherein the animal is a mouse.

Embodiment 1395

The method of claim 1393 wherein the animal is a human.

Embodiment 1396

The method of any of claims 1393 to 1395, wherein the disease or condition is a liver disease or condition.

Embodiment 1397

The method of any of claims 1393 to 1395 wherein the administration is parenteral.

Embodiment 1398

The method claim 1397 wherein the administration is by subcutaneous injection.

Embodiment 1399

The method of claim 1397 wherein the administration is by intravenous injection.

Embodiment 1400

The method of claim 1397 wherein the administration is by intramuscular injection.

Embodiment 1401

The method of any of claims 1393 to 1400 wherein the conjugated oligonucleotide is provided at a dose of 1-10 mg/kg.

Embodiment 1402

The method of any of claims 1393 to 1400 wherein the conjugated oligonucleotide is provided at a dose of less than 1 mg/kg.

Embodiment 1403

The method of any of claims 1393 to 1400 wherein the conjugated oligonucleotide is provided at a dose of greater than 10 mg/kg.

Embodiment 1404

The method of any of claims 1393 to 1403 wherein the conjugated oligonucleotide is provided for a dosing period of at least 2 months.

Embodiment 1405

The method of any of claims 1393 to 1403 wherein the conjugated oligonucleotide is provided for a dosing period of at least 4 months.

Embodiment 1406

The method of any of claims 1393 to 1403 wherein the conjugated oligonucleotide is provided for a dosing period of at least 6 months.

Embodiment 1407

The method of any of claims 1393 to 1403 wherein the conjugated oligonucleotide is provided at a dosing frequency of about one dose every week.

Embodiment 1408

The method of any of claims 1393 to 1403 wherein the conjugated oligonucleotide is provided at a dosing frequency of about one dose every two weeks.

Embodiment 1409

The method of any of claims 1393 to 1403 wherein the conjugated oligonucleotide is provided at a dosing frequency of about one dose every three weeks.

Embodiment 1410

The method of any of claims 1393 to 1403 wherein the conjugated oligonucleotide is provided at a dosing frequency of one dose every four weeks.

Embodiment 1411

The method of any of claims 1393 to 1403 wherein the conjugated oligonucleotide is provided at a dosing frequency of one dose every five weeks.

Embodiment 1412

The method of any of claims 1393 to 1403 wherein the conjugated oligonucleotide is provided at a dosing frequency of one dose every six weeks.

Embodiment 1413

The method of any of claims 1393 to 1403 wherein the conjugated oligonucleotide is provided at a dosing frequency of one dose every seven weeks.

Embodiment 1414

The method of any of claims 1393 to 1403 wherein the conjugated oligonucleotide is provided at a dosing frequency of one dose every eight weeks.

Embodiment 1415

A conjugated antisense compound comprising: an antisense oligonucleotide comprising 12-30 linked nucleosides, and a conjugate group, wherein the conjugate group comprises at least one cell-targeting moiety.

Embodiment 1416

A method of reducing the activity or amount of an Apolipoprotein C-III protein in a cell, comprising contacting a cell with at least one conjugated antisense compound of any of claims 1098 to 1385; and thereby reducing the activity or amount of the Apolipoprotein C-III protein in the cell.

Embodiment 1417

A method of decreasing total cholesterol, comprising contacting a cell with at least one compound of any of claims 1098 to 1385; and thereby decreasing total cholesterol.

Embodiment 1418

A method of decreasing triglycerides, comprising contacting a cell with at least one compound of any of claims 1098 to 1385; and thereby decreasing triglycerides.

Embodiment 1419

A method of lowering LDL, comprising contacting a cell with at least one compound of any of claims 1098 to 1385; and thereby lowering LDL.

Embodiment 1420

A method of increasing HDL, comprising contacting a cell with at least one compound of any of claims 1098 to 1385; and thereby increasing HDL.

Embodiment 1421

The method of any of claims 1416 to 1420, wherein the cell is in vitro.

Embodiment 1422

The method of any of claims 1416 to 1420, wherein the cell is in an animal.

Embodiment 1423

The method of any of claims 1416 to 1420, wherein the animal is a human

Embodiment 1424

The compound or conjugated oligonucleotide of any of claims 1-1385 or a prodrug thereof.

Embodiment 1425

A method of manufacturing an antisense oligonucleotide of any of claims 1-1385.

Embodiment 1426

A method of preparing an antisense oligonucleotide of any of claims 1-1385.

Embodiment 1427

A process for manufacturing a conjugated antisense compound of any one of claims 1-1385, wherein the method includes formulating the conjugated antisense compound for human use, performing chromatogram analysis of the formulated conjugated antisense compound, and packaging the conjugated antisense compound ready for sale.

Embodiment 1428

The conjugated oligonucleotide compound of any of embodiments 1237 to 1360, wherein the conjugated oligonucleotide comprises the nucleobase sequence of any of SEQ ID NOs.: 117, 118, 119, 120, 121, 122, 123, 124, 125, 126, or 127.

Embodiment 1429

A compound having the formula (V):

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, or GalNAc-23a.

and the other of $T_3$ or $T_4$ is selected from among: a hydroxyl, a hydroxyl protecting group, a nucleoside, an oligonucleotide, a monomeric subunit, or an oligomeric compound; and wherein Bx is a heterocyclic base moiety.

Embodiment 1430

A compound having the formula (Va):

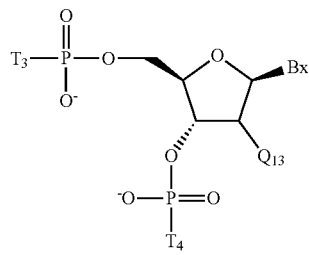

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, or GalNAc$_3$-23a.

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety; and wherein $Q_{13}$ is selected from among: a halogen, OCH$_3$, OCF$_3$, OCH$_2$CH$_3$, OCH$_2$CF$_3$, OCH$_2$—CH=CH$_2$, O(CH$_2$)$_2$—OCH$_3$ (MOE), O(CH$_2$)$_2$—O(CH$_2$)$_2$—N(CH$_3$)$_2$, OCH$_2$C(=O)—N(H)CH$_3$, OCH$_2$C(=O)—N(H)—(CH$_2$)$_2$—N(CH$_3$)$_2$, and OCH$_2$—N(H)—C(=NH)NH$_2$.

Embodiment 1431

A compound having the formula (XXV):

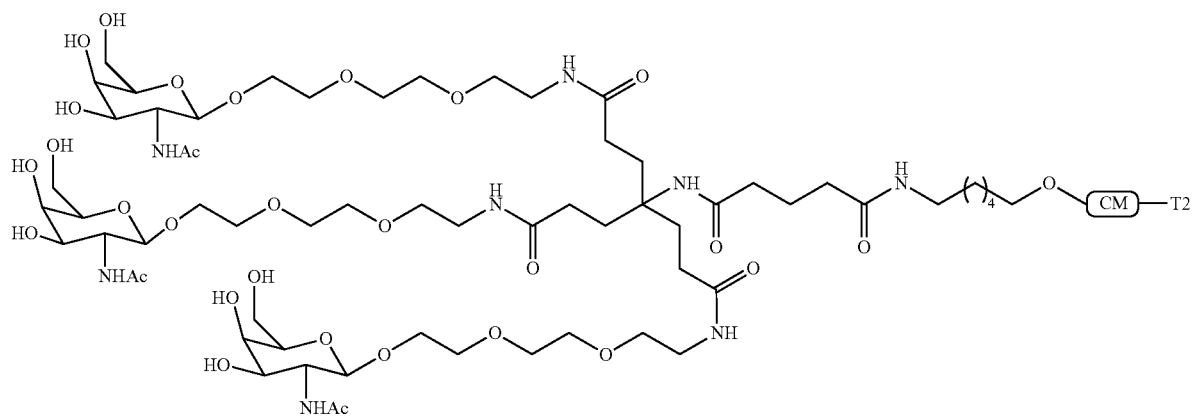

wherein:
$T_2$ is a nucleoside, a nucleotide, a monomeric subunit, or an oligomeric compound.

Embodiment 1432

A compound having the formula (XXVI):

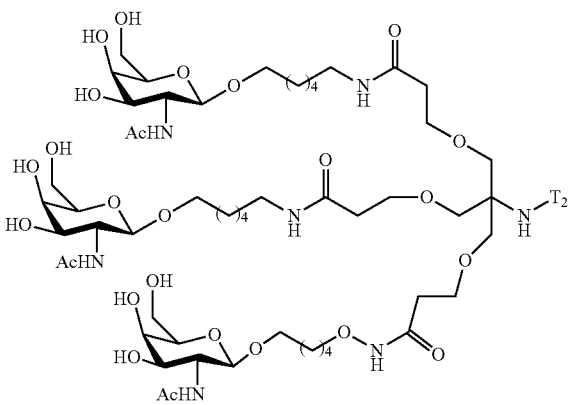

(XXVI)

wherein:
$T_2$ comprises a nucleoside, a nucleotide, a monomeric subunit, a reactive ester, a linker, a cleavable moiety or an oligomeric compound.

Embodiment 1433
A compound having the formula (XXVII):
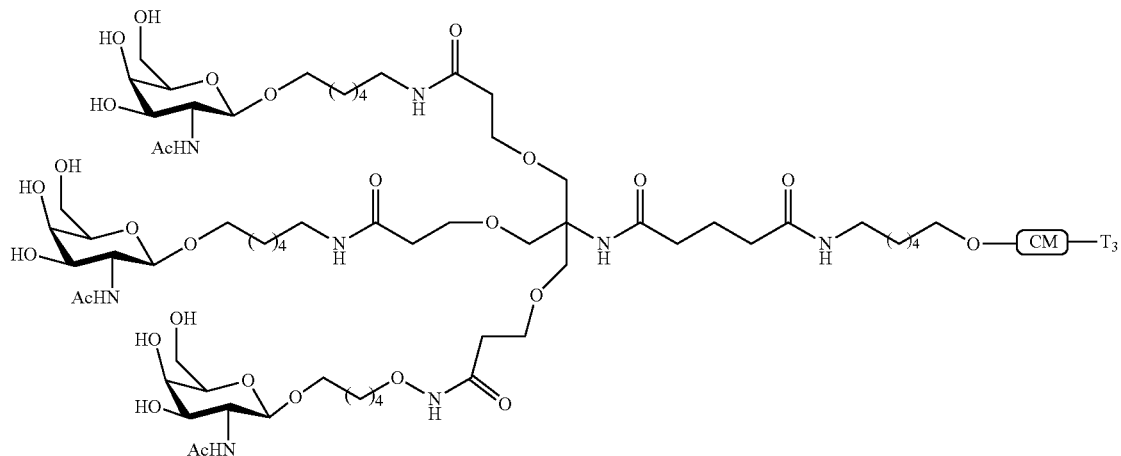
(XXVII)
wherein:
CM represents a cleavable moiety and $T_3$ is a nucleoside, a nucleotide, a monomeric subunit, or an oligomeric compound.
Embodiment 1434
A compound having the formula (XXVIII):
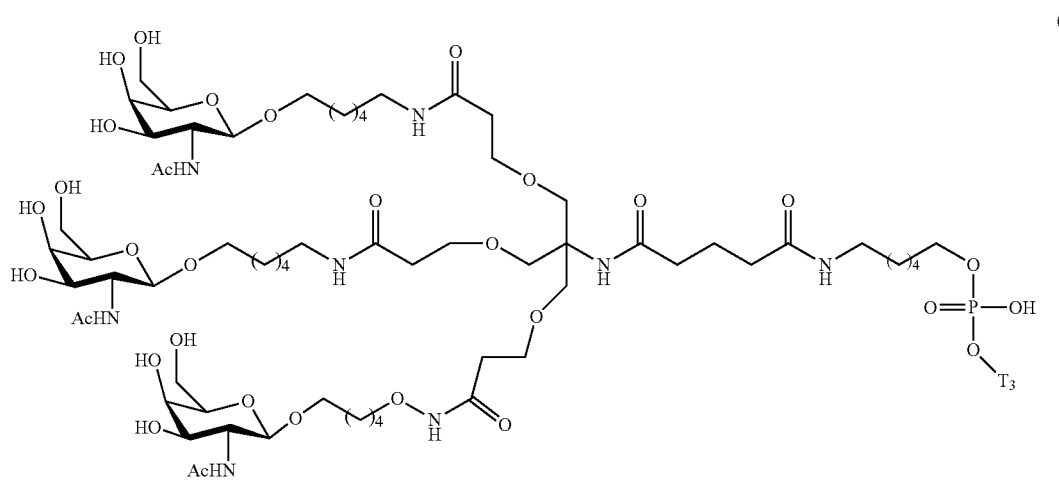
(XXVIII)
Wherein:
$T_3$ is a nucleoside, a nucleotide, a monomeric subunit, or an oligomeric compound.

Embodiment 1435
A compound having the formula (XXIX):
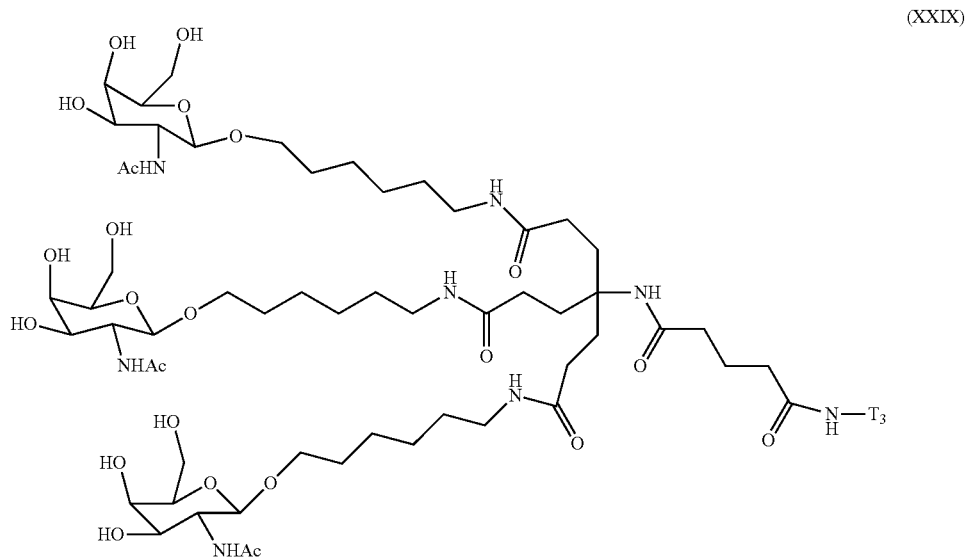
(XXIX)
wherein:
$T_3$ is a group comprising a nucleoside, a nucleotide, a monomeric subunit, or an oligomeric compound.
Embodiment 1436
A compound having the formula (XXX):
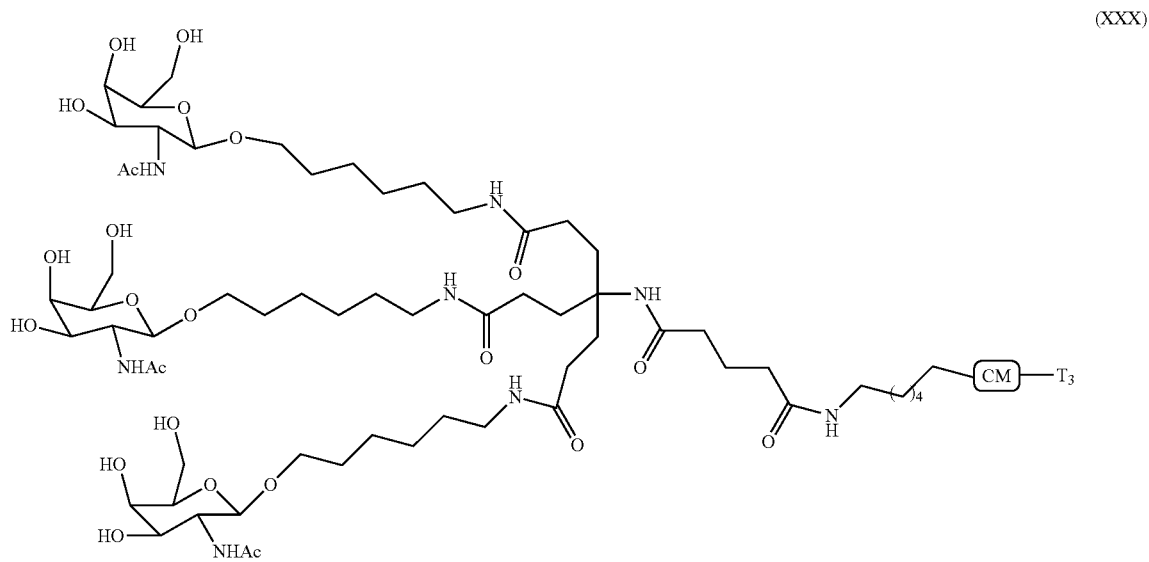
(XXX)
wherein:
CM represents a cleavable moiety and $T_3$ is a nucleoside, a nucleotide, a monomeric subunit, or an oligomeric compound.

Embodiment 1437

A compound having formula (XXXI):

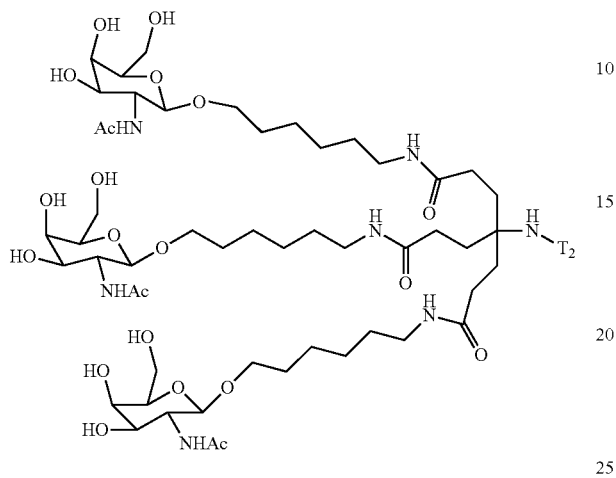

(XXXI)

wherein:

T$_2$ is a group comprising a nucleoside, a nucleotide, a monomeric subunit, a reactive ester, a linker, a cleavable moiety or an oligomeric compound.

Embodiment 1438

A compound having the formula (XXXII):

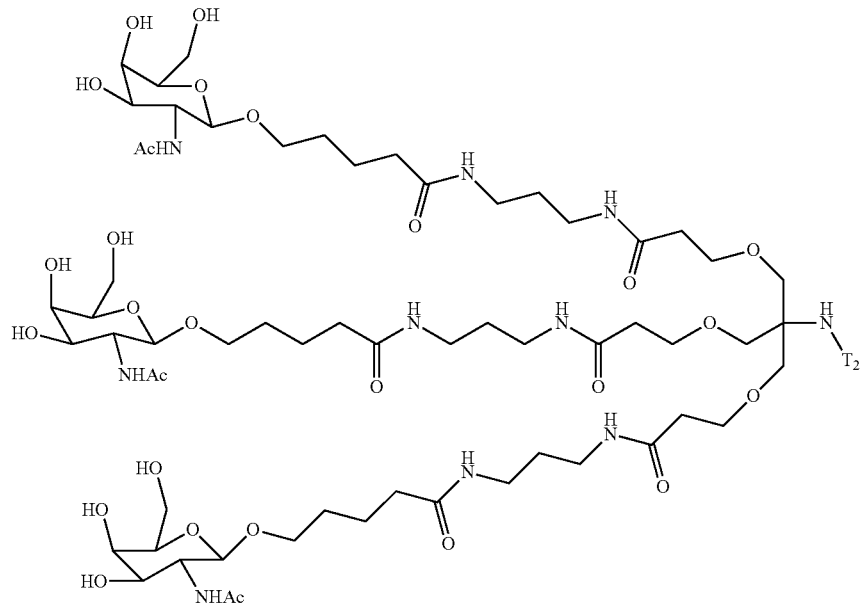

(XXXII)

wherein:

T$_2$ is a group comprising a nucleoside, a nucleotide, a monomeric subunit, a reactive ester, a linker, a cleavable moiety or an oligomeric compound.

Embodiment 1439
A compound having the formula (XXXIII):
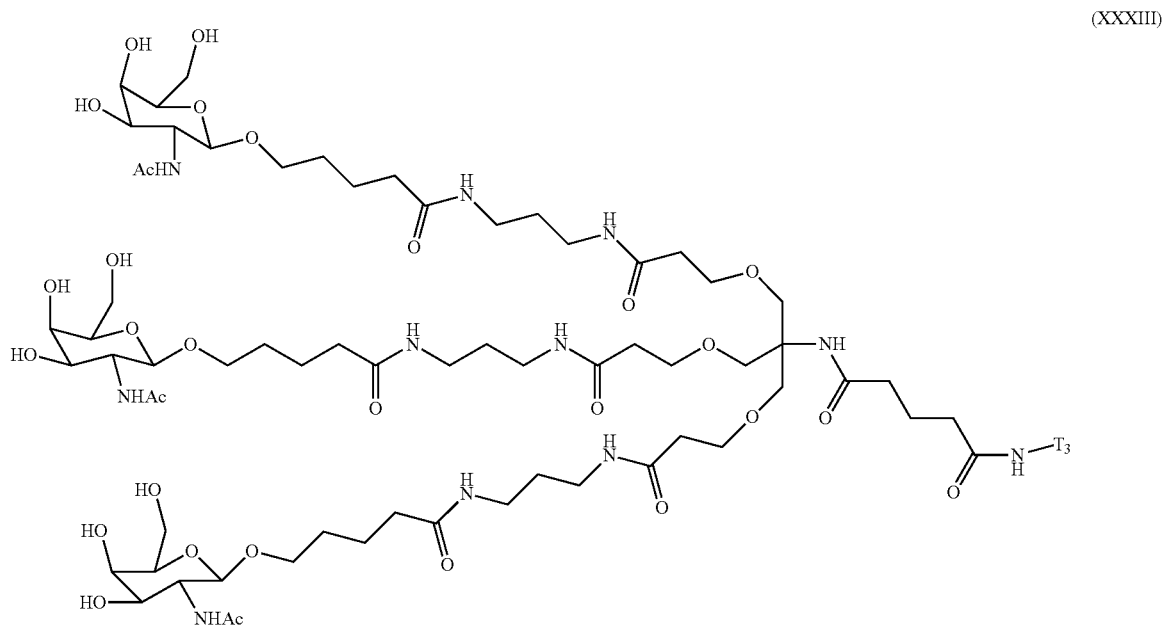
(XXXIII)
wherein:
T₃ is a group comprising a nucleoside, a nucleotide, a monomeric subunit, or an oligomeric compound.
Embodiment 1440
A compound having formula (XXXIV):
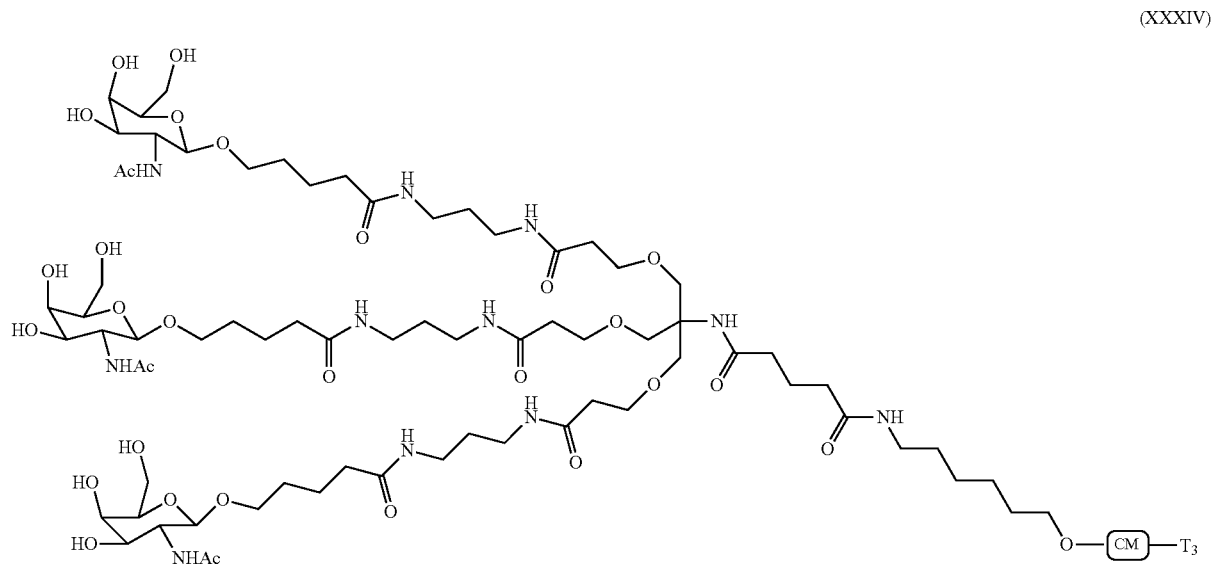
(XXXIV)
wherein:
CM represents a cleavable moiety and T₃ is a nucleoside, a nucleotide, a monomeric subunit, or an oligomeric compound.

Embodiment 1441
A compound having the formula (XXXV):
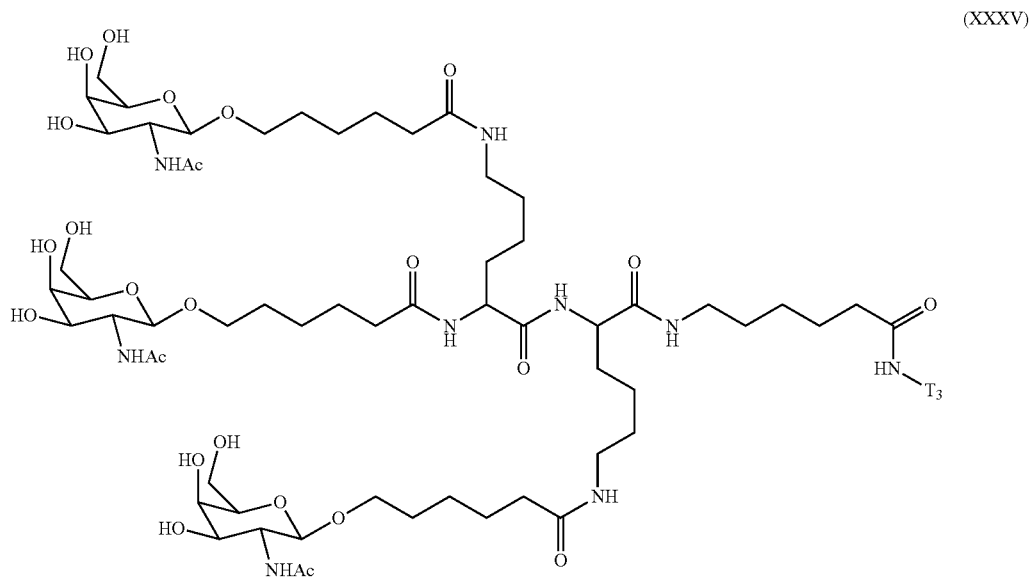
wherein:
T_3 is a group comprising a linker, nucleoside, a nucleotide, a monomeric subunit, or an oligomeric compound.
Embodiment 1442
A compound having the formula (XXXVI):
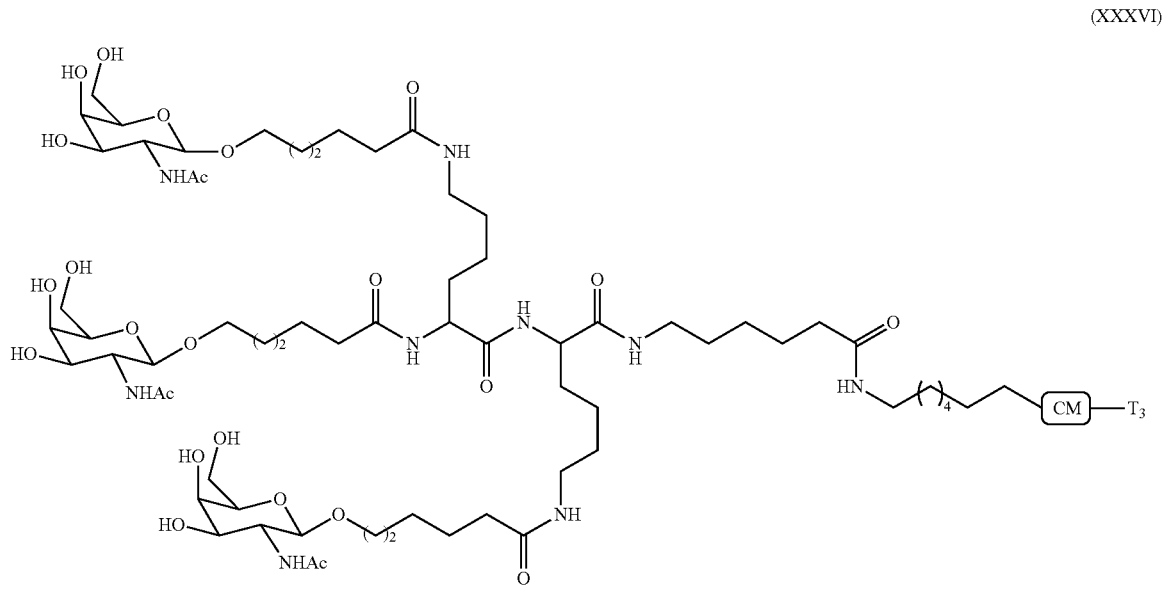
wherein:
CM represents a cleavable moiety and $T_3$ is a nucleoside, a nucleotide, a monomeric subunit, or an oligomeric compound.

409
Embodiment 1443

A compound having formula (XXXVII):

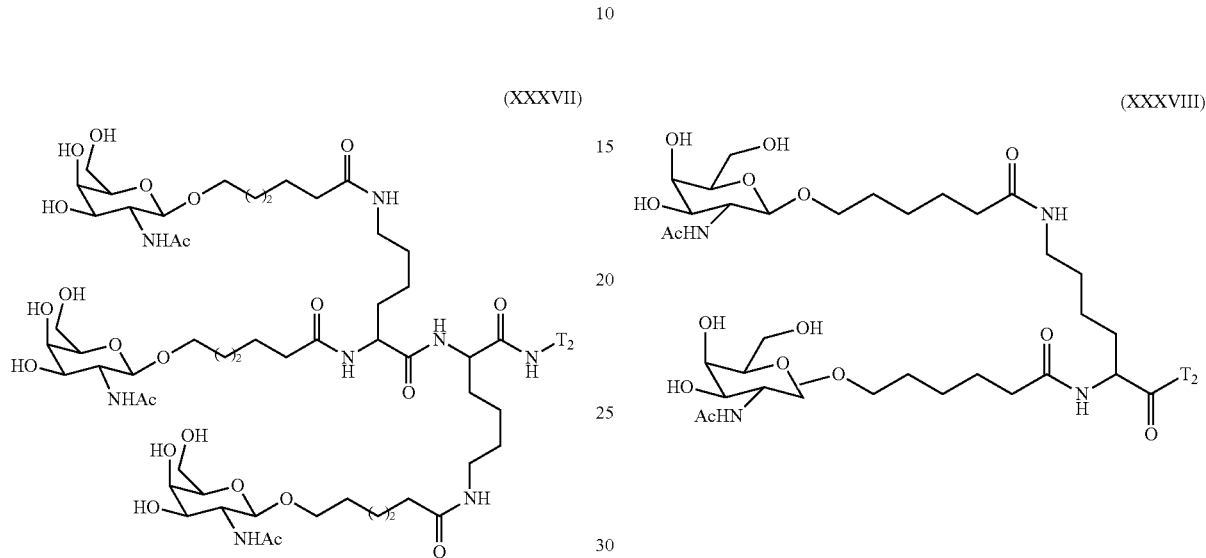

(XXXVII)

wherein:
T₂ is a group comprising a nucleoside, a nucleotide, a monomeric subunit, a reactive ester, a linker, a cleavable moiety or an oligomeric compound.

410
Embodiment 1444

A compound having formula (XXXVIII):

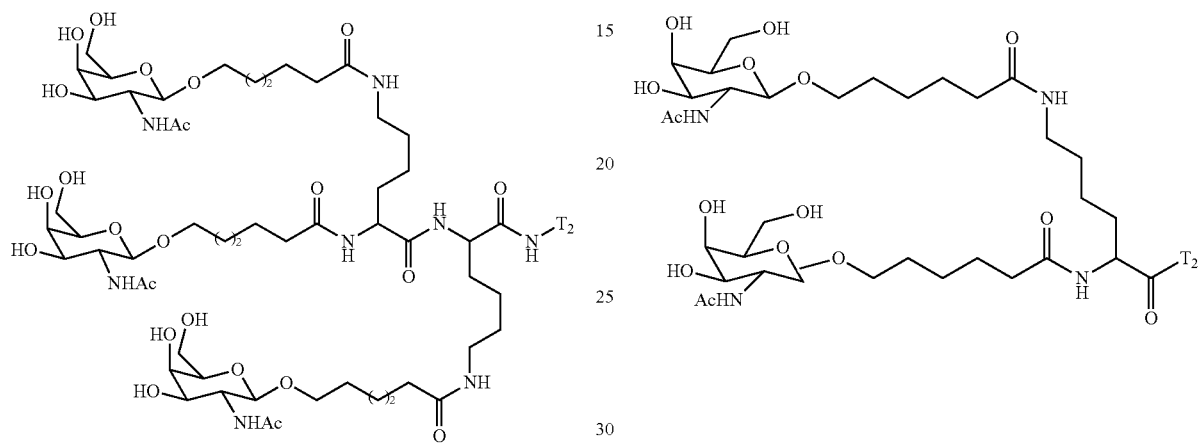

(XXXVIII)

wherein: T₂ is a group comprising a nucleoside, a nucleotide, a monomeric subunit, a reactive ester, a linker, a cleavable moiety or an oligomeric compound.

Embodiment 1445

A compound having formula (XXXIX):

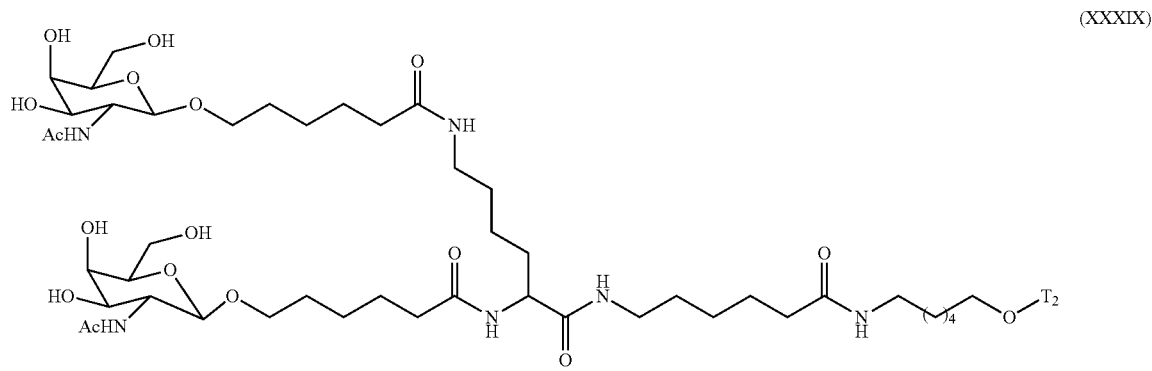

(XXXIX)

wherein: $T_2$ is a nucleoside, a nucleotide, a monomeric subunit, a reactive ester, a linker, a cleavable moiety or an oligomeric compound.

Embodiment 1446

A compound having formula (XL):

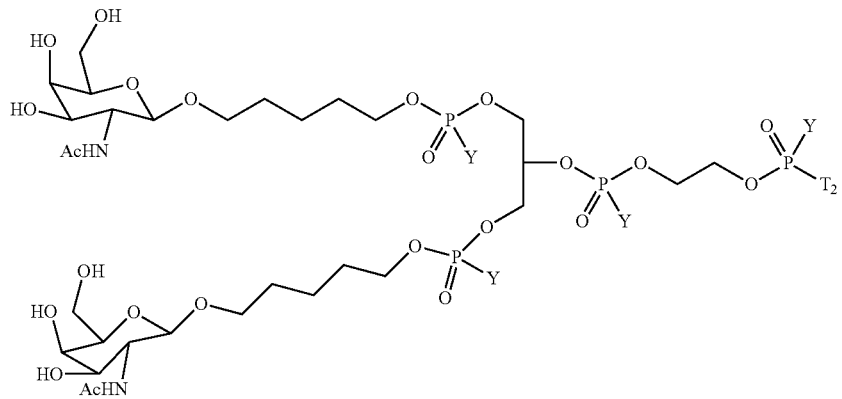

(XL)

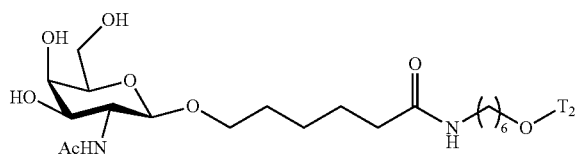

wherein: $T_2$ is a group comprising a nucleoside, a nucleotide, a monomeric subunit, a reactive ester, a linker, a cleavable moiety or an oligomeric compound.

Embodiment 1447

A compound having formula (XLI):

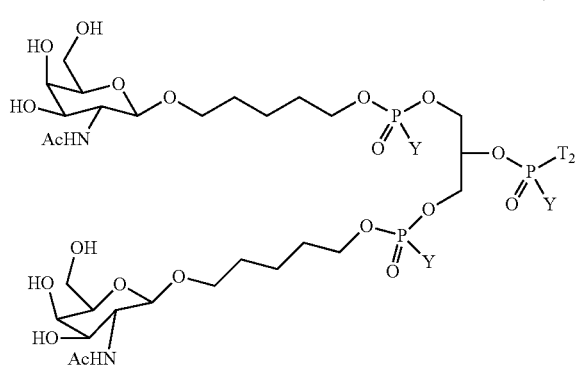

(XLI)

wherein each Y is selected from O, S, a substituted or unsubstituted $C_1$-$C_{10}$ alkyl, amino, substituted amino, azido, alkenyl or alkynyl;

and wherein $T_2$ is a group comprising a nucleoside, a nucleotide, a monomeric subunit, a reactive ester, a linker, a cleavable moiety or an oligomeric compound.

Embodiment 1448

A compound having formula (XLII):

(XLII)

wherein each Y is selected from O, S, a substituted or unsubstituted $C_1$-$C_{10}$ alkyl, amino, substituted amino, azido, alkenyl or alkynyl;

and wherein $T_2$ is a group comprising a nucleoside, a nucleotide, a monomeric subunit, a reactive ester, a linker, a cleavable moiety or an oligomeric compound.

Embodiment 1449

A compound having formula (XLIII):

(XLIII)

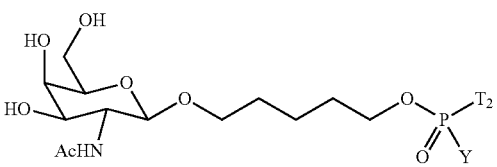

wherein Y is selected from O, S, a substituted or unsubstituted $C_1$-$C_{10}$ alkyl, amino, substituted amino, azido, alkenyl or alkynyl;

and wherein $T_2$ is a group comprising a nucleoside, a nucleotide, a monomeric subunit, a reactive ester, a linker, a cleavable moiety or an oligomeric compound.

Embodiment 1450

A compound having formula (XLIV):

(XLIV)

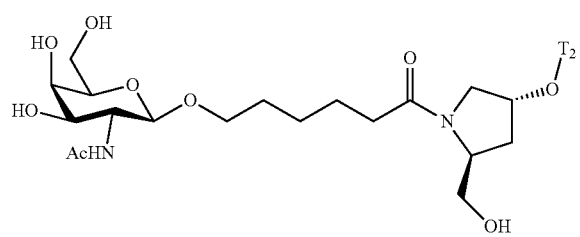

wherein T₂ is a group comprising a nucleoside, a nucleotide, a monomeric subunit, a reactive ester, a linker, a cleavable moiety or an oligomeric compound.

Embodiment 1451

A compound having formula (XLV):

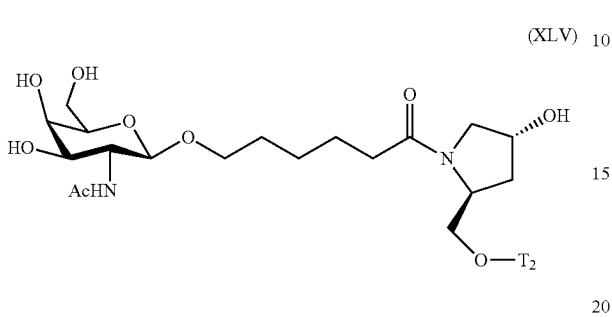

wherein T₂ is a group comprising a nucleoside, a nucleotide, a monomeric subunit, a reactive ester, a linker, a cleavable moiety or an oligomeric compound.

Embodiment 1452

A compound having formula (XLV):

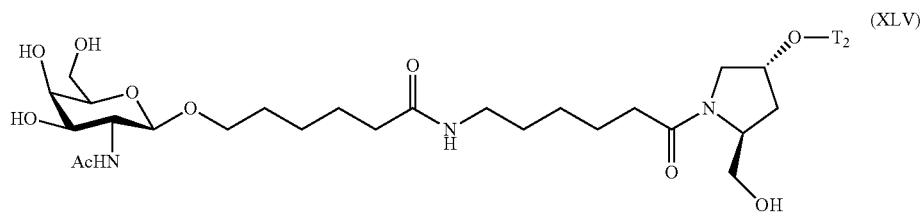

wherein T₂ is a group comprising a nucleoside, a nucleotide, a monomeric subunit, a reactive ester, a linker, a cleavable moiety or an oligomeric compound.

Embodiment 1453

A compound having formula (XLV):

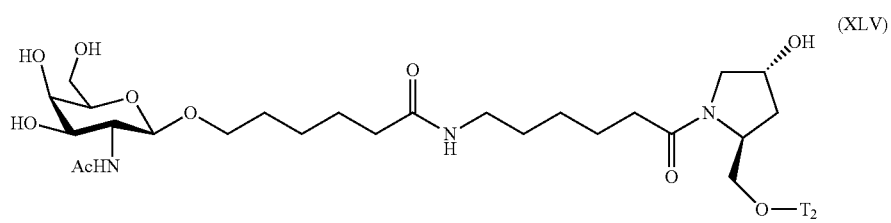

wherein T₂ is a group comprising a nucleoside, a nucleotide, a monomeric subunit, a reactive ester, a linker, a cleavable moiety or an oligomeric compound.

Embodiment 1454

The compound of any of embodiments 1432 to 1453, wherein T₂ or T₃ is selected from among:

-continued

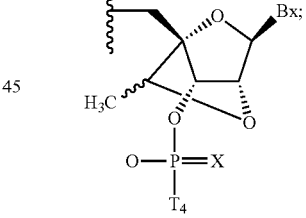

wherein:
Bx is a heterocyclic base moiety;
T₄ is H, a hydroxyl protecting group or a reactive phosphorus group;

X is O or S;

Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio;

and wherein $T_4$ is a nucleoside, a monomeric subunit, or an oligomeric compound.

Embodiment 1455

A compound having the formula:

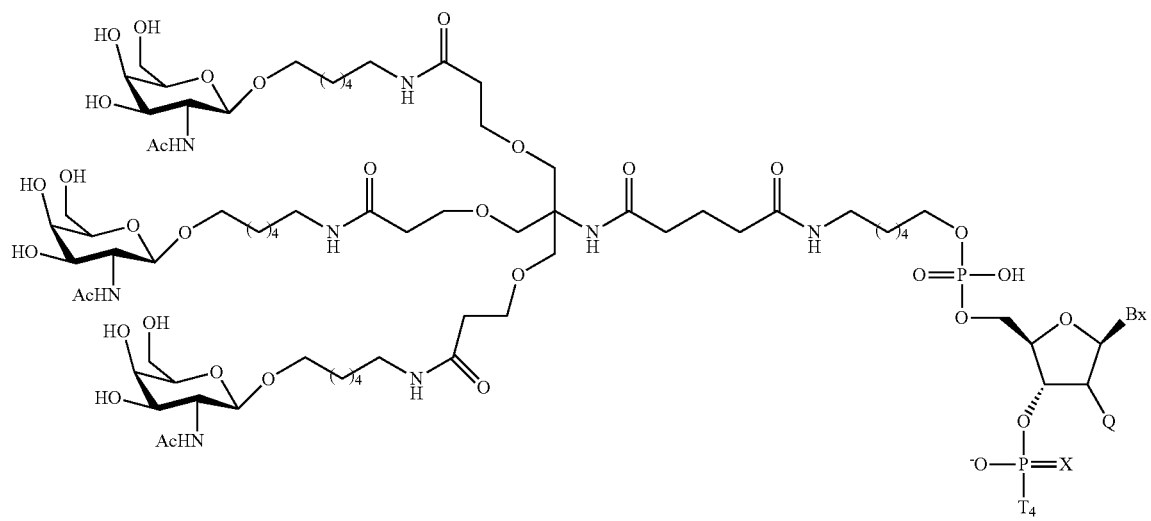

wherein X is O or S;
wherein Bx is a heterocyclic base moiety;
wherein Q is selected from among: H, a halogen, $OCH_3$, $OCF_3$, $OCH_2CH_3$, $OCH_2CF_3$, $OCH_2$—$CH$=$CH_2$, $O(CH_2)_2$—$OCH_3$, $O(CH_2)_2$—$O(CH_2)_2$—$N(CH_3)_2$, $OCH_2C$(=O)—$N(H)CH_3$, $OCH_2C$(=O)—$N(H)$—$(CH_2)_2$—$N(CH_3)_2$, and $OCH_2$—$N(H)$—$C$(=$NH$)$NH_2$;
and wherein $T_4$ is a nucleoside, a monomeric subunit, or an oligomeric compound.

Embodiment 1456

A compound having the formula:

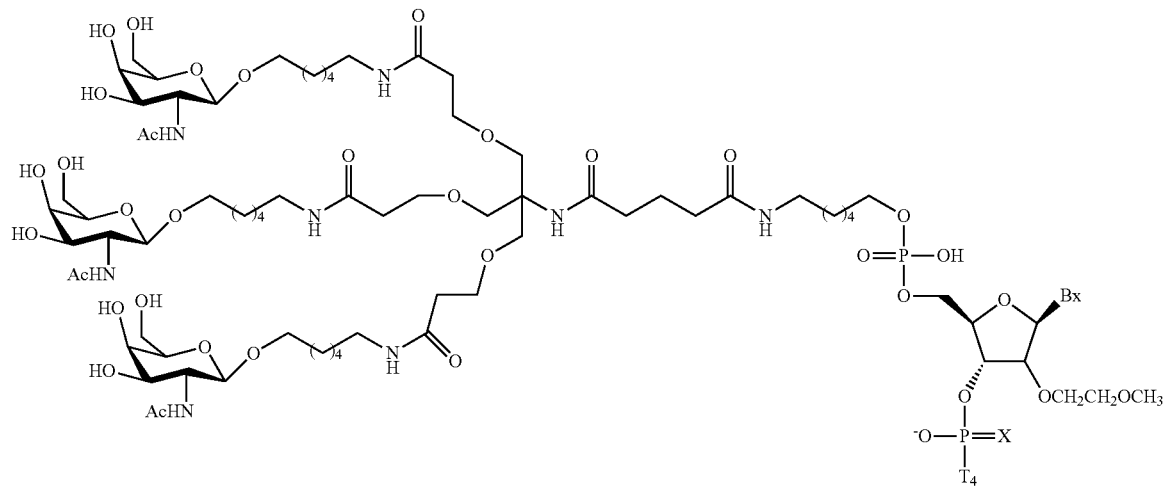

wherein X is O or S;
wherein Bx is a heterocyclic base moiety;
and wherein T₄ is a nucleoside, a monomeric subunit, or an oligomeric compound.

Embodiment 1457

A compound having the formula:

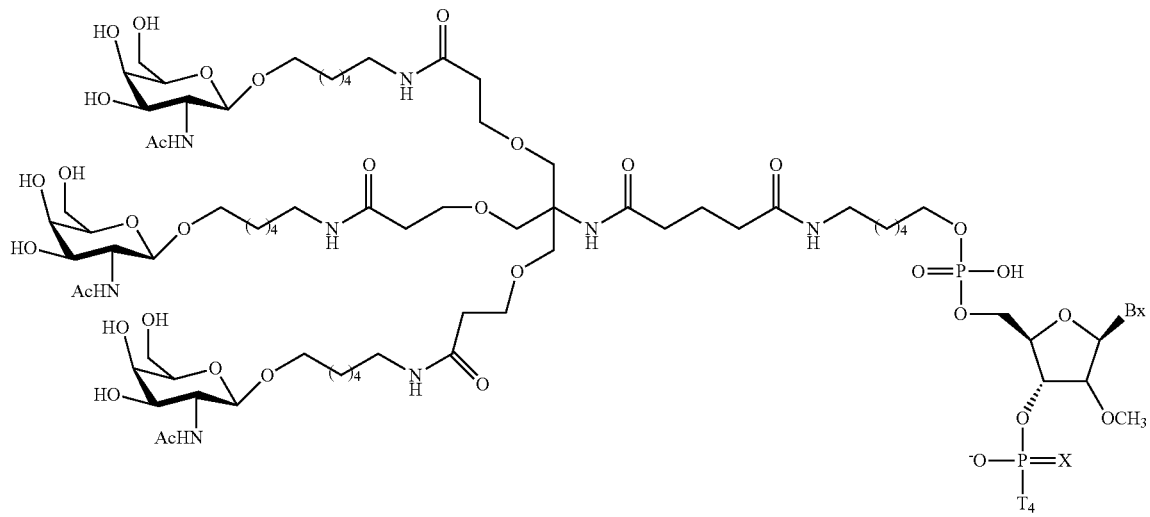

wherein X is O or S;
wherein Bx is a heterocyclic base moiety;
wherein T₄ is a nucleoside, a monomeric subunit, or an oligomeric compound.

Embodiment 1458

A compound having the formula:

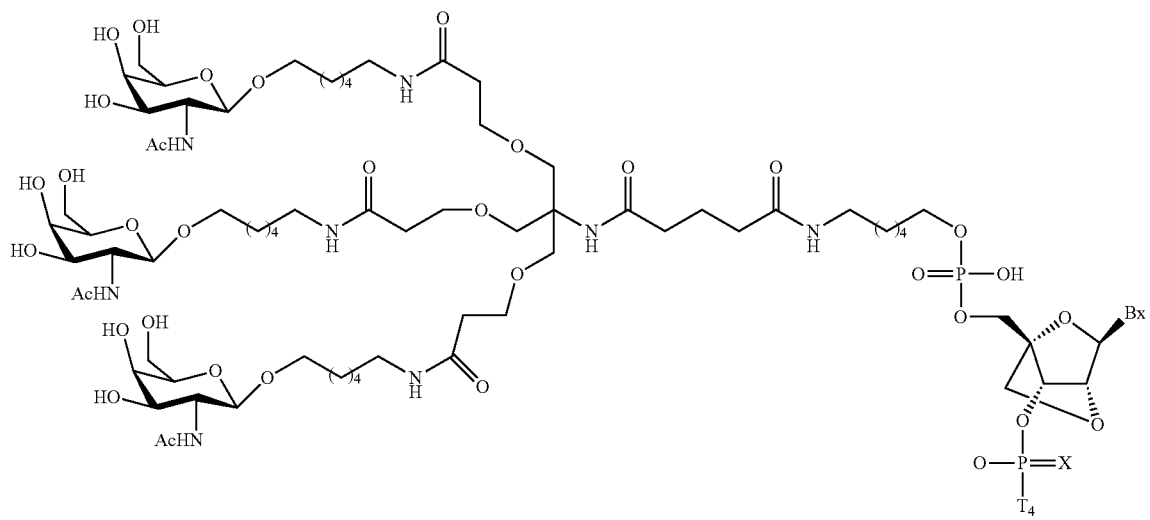

wherein X is O or S;
wherein Bx is a heterocyclic base moiety;
wherein T₄ is a nucleoside, a monomeric subunit, or an oligomeric compound.

Embodiment 1459

A compound having the formula:

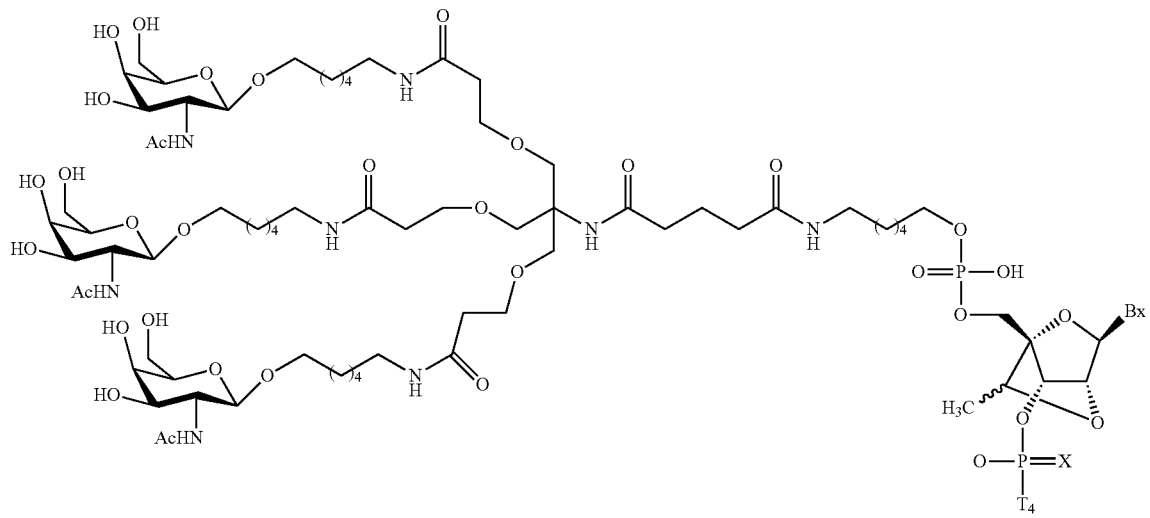

wherein X is O or S;
wherein Bx is a heterocyclic base moiety;
wherein $T_4$ is a nucleoside, a monomeric subunit, or an oligomeric compound.

Embodiment 1460

A compound having the formula:

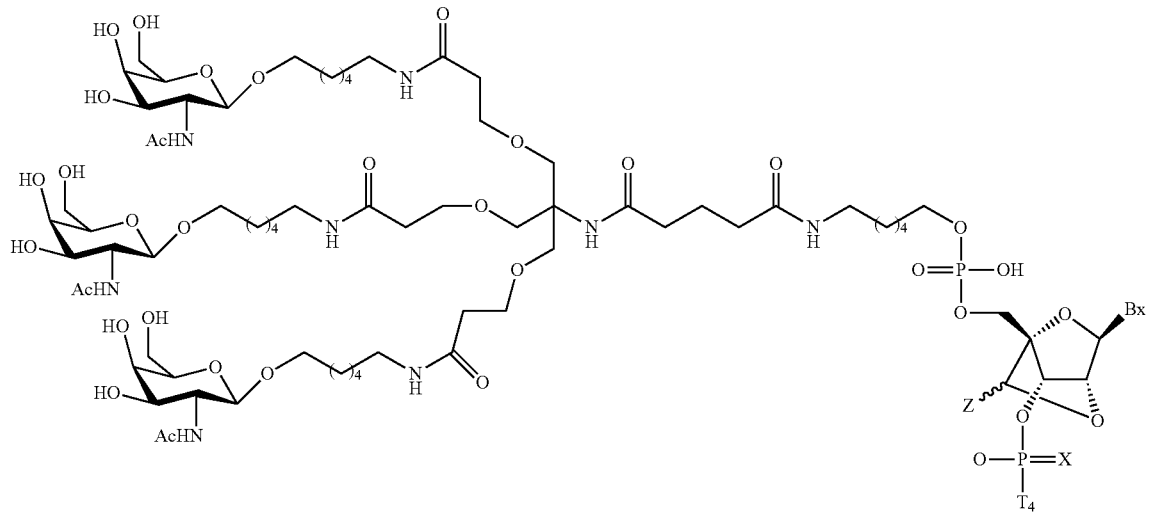

wherein X is O or S;
wherein Bx is a heterocyclic base moiety;
wherein Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, or substituted amide; and
wherein $T_4$ is a nucleoside, a monomeric subunit, or an oligomeric compound.

Embodiment 1461

A compound having the formula:

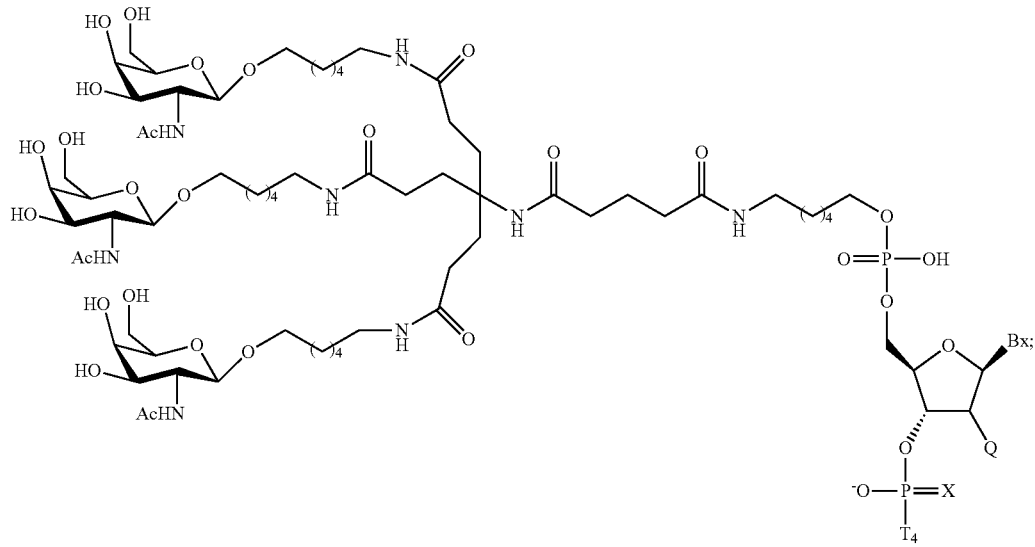

wherein X is O or S;
wherein Bx is a heterocyclic base moiety;
wherein Q is selected from among: a halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$ and
wherein $T_4$ is a nucleoside, a monomeric subunit, or an oligomeric compound.

Embodiment 1462

A compound having the formula:

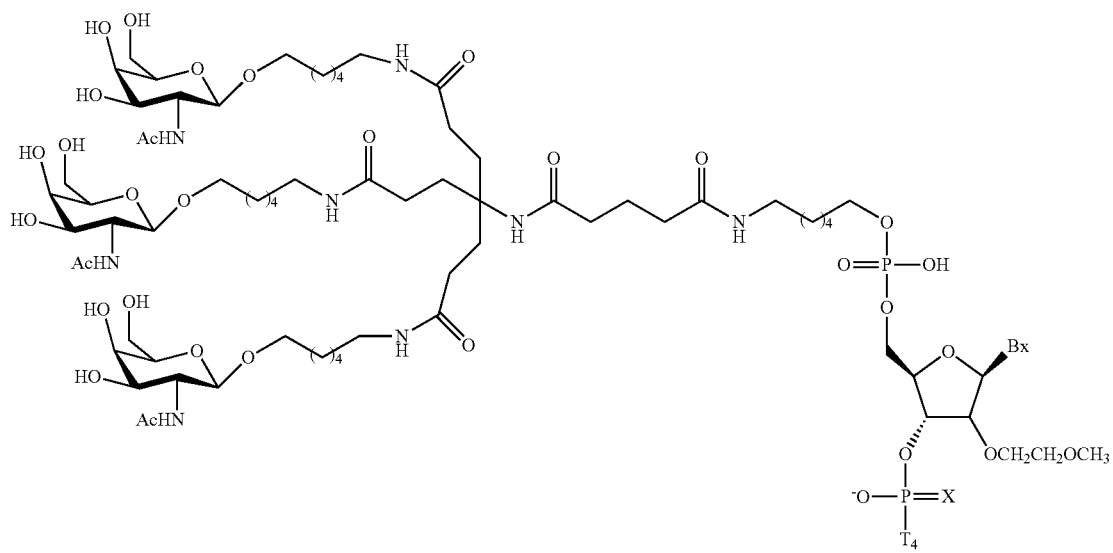

wherein X is O or S;
wherein Bx is a heterocyclic base moiety;
wherein $T_4$ is a nucleoside, a monomeric subunit, or an oligomeric compound.

Embodiment 1463
A compound having the formula:
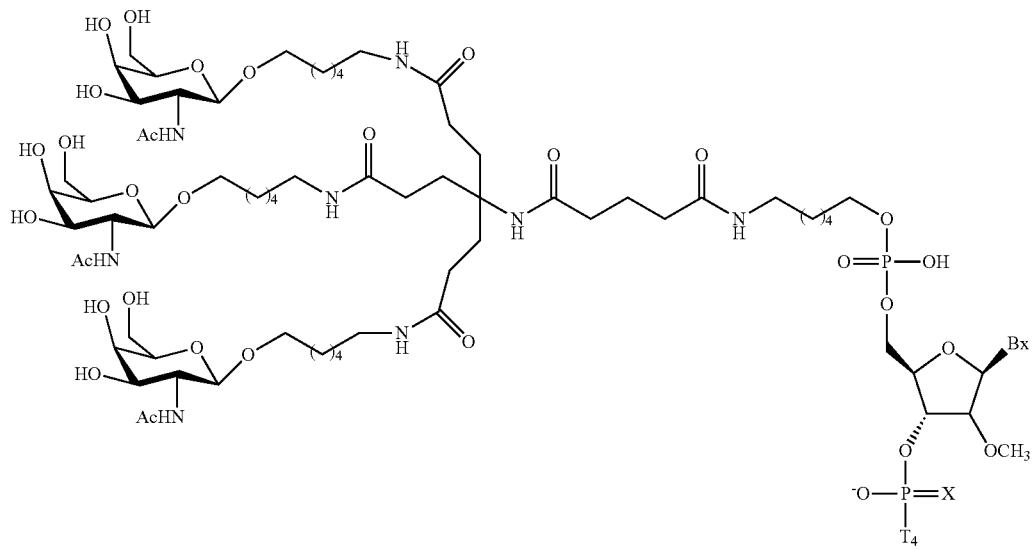
wherein X is O or S;
wherein Bx is a heterocyclic base moiety;
wherein $T_4$ is a nucleoside, a monomeric subunit, or an oligomeric compound.
Embodiment 1464
A compound having the formula:
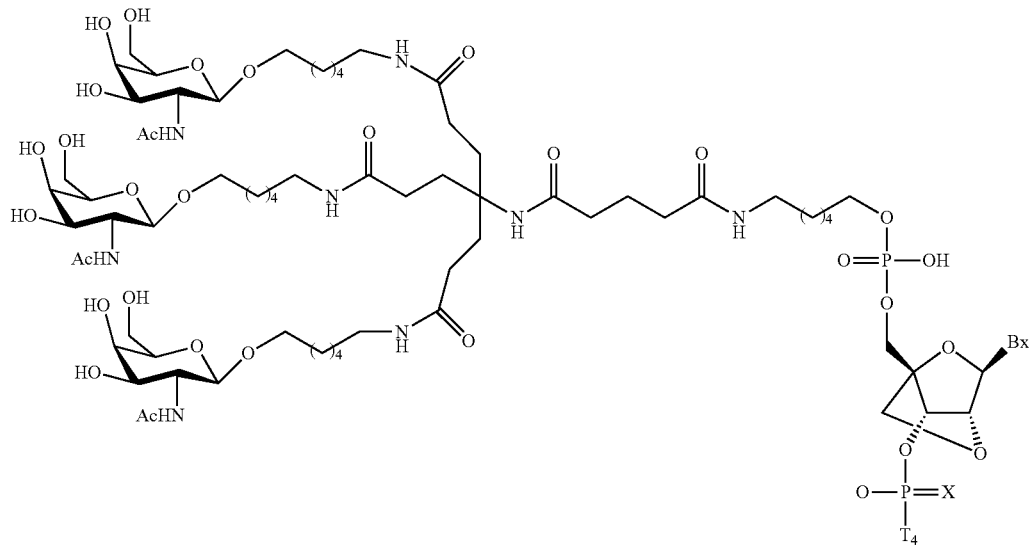
wherein X is O or S;
wherein Bx is a heterocyclic base moiety;
wherein $T_4$ is a nucleoside, a monomeric subunit, or an oligomeric compound.

Embodiment 1465

A compound having the formula:

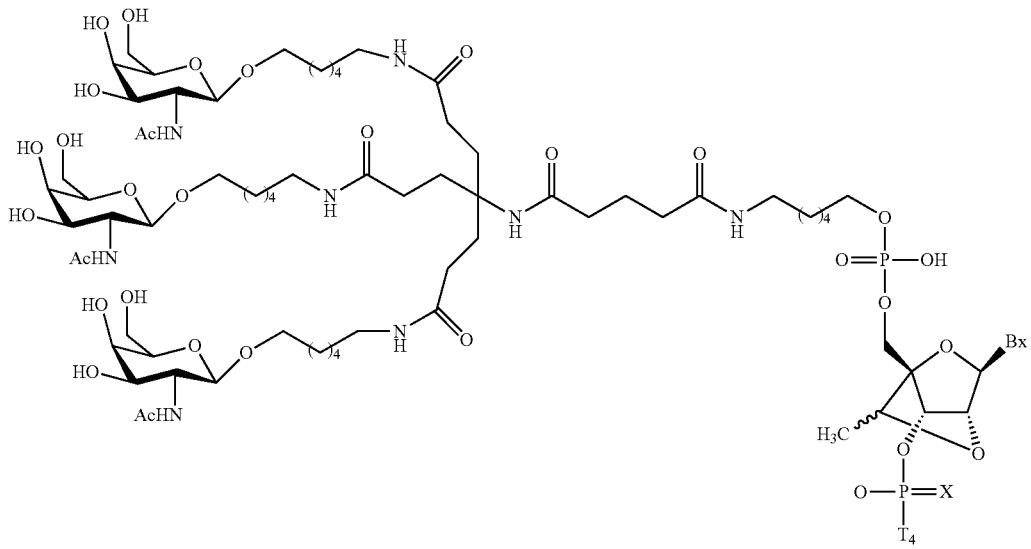

wherein X is O or S;
wherein Bx is a heterocyclic base moiety;
wherein $T_4$ is a nucleoside, a monomeric subunit, or an oligomeric compound.

Embodiment 1466

A compound having the formula:

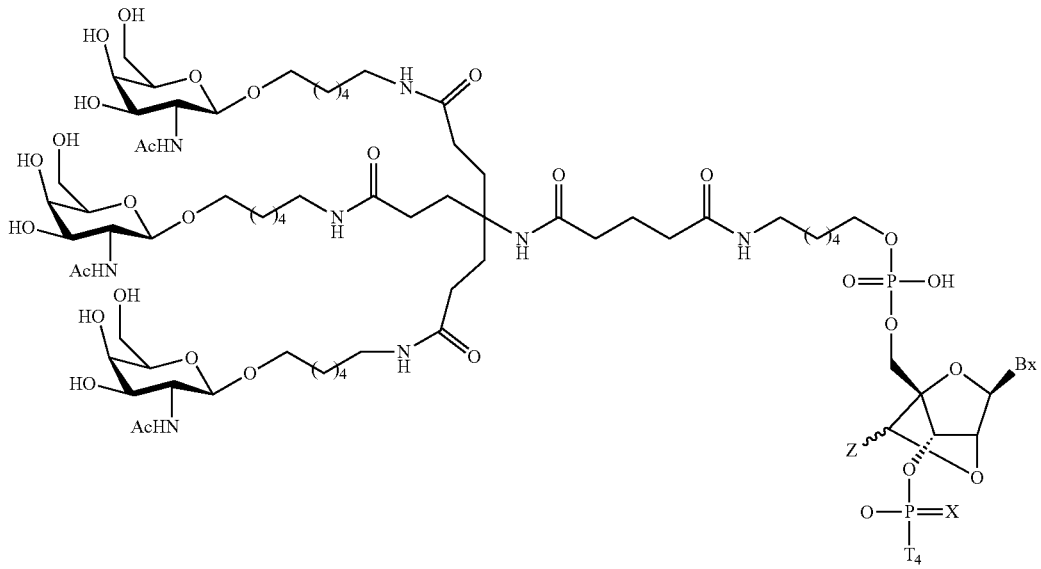

wherein X is O or S;
wherein Bx is a heterocyclic base moiety;
wherein Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, or substituted amide; and
wherein $T_4$ is a nucleoside, a monomeric subunit, or an oligomeric compound.

Embodiment 1467

A compound having the formula:

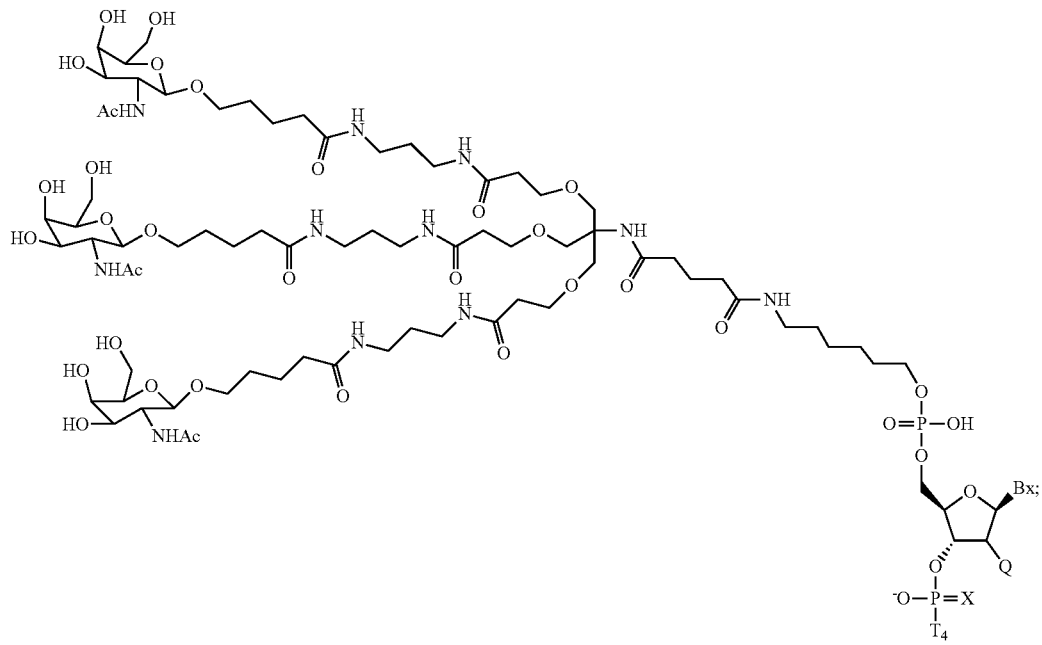

wherein X is O or S;
wherein Bx is a heterocyclic base moiety;
wherein Q is selected from among: a halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$;
wherein $T_4$ is a nucleoside, a monomeric subunit, or an oligomeric compound.

Embodiment 1468

A compound having the formula:

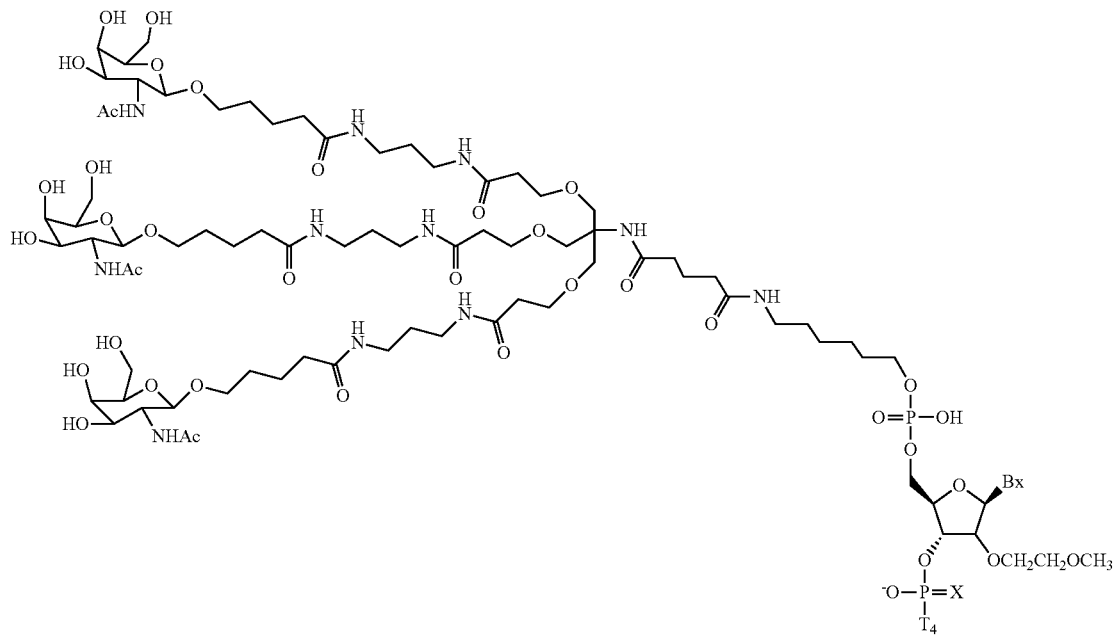

wherein X is O or S;
wherein Bx is a heterocyclic base moiety;
wherein $T_4$ is a nucleoside, a monomeric subunit, or an oligomeric compound.

Embodiment 1469
A compound having the formula:
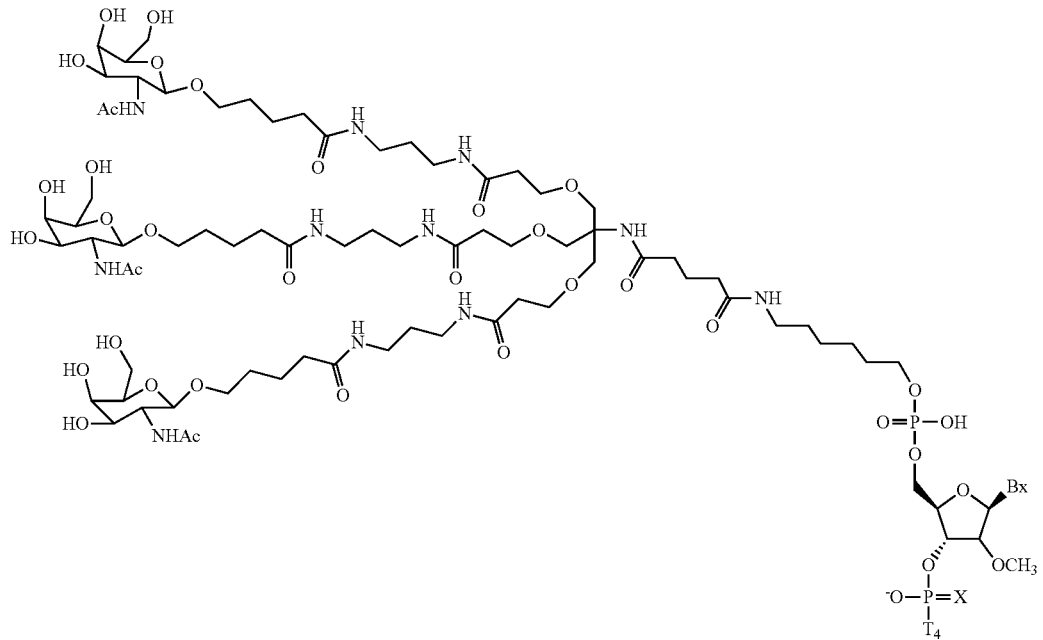
wherein X is O or S;
wherein Bx is a heterocyclic base moiety;
wherein $T_4$ is a nucleoside, a monomeric subunit, or an oligomeric compound.
Embodiment 1470
A compound having the formula:
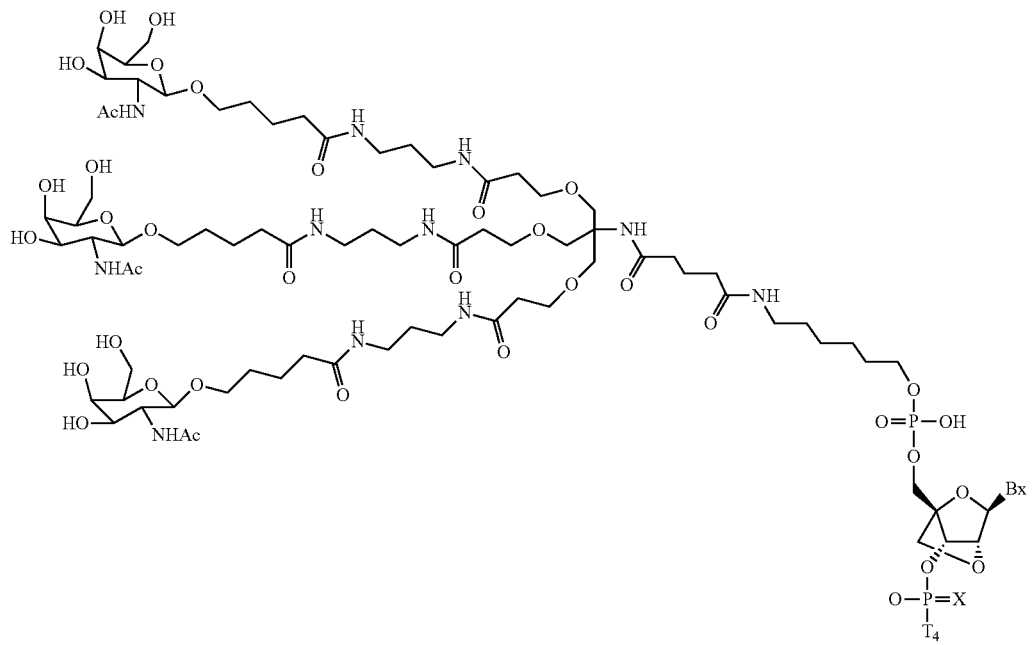

wherein X is O or S;
wherein Bx is a heterocyclic base moiety;
wherein Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, or substituted amide; and
wherein $T_4$ is a nucleoside, a monomeric subunit, or an oligomeric compound.

Embodiment 1471

A compound having the formula:

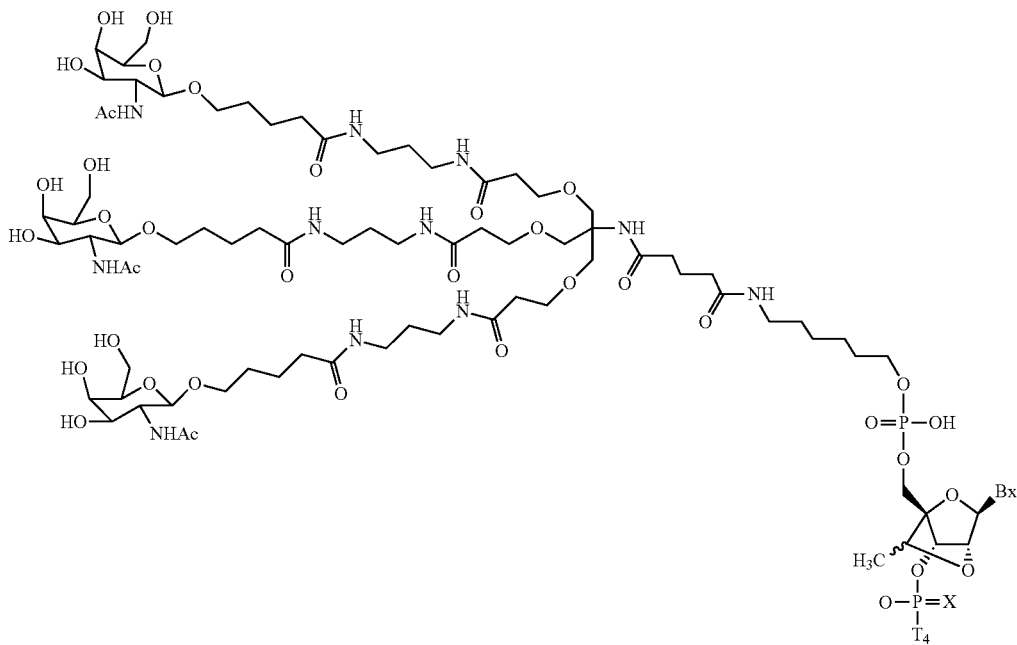

wherein X is O or S;
wherein Bx is a heterocyclic base moiety;
wherein $T_4$ is a nucleoside, a monomeric subunit, or an oligomeric compound.

Embodiment 1472

A compound having the formula:

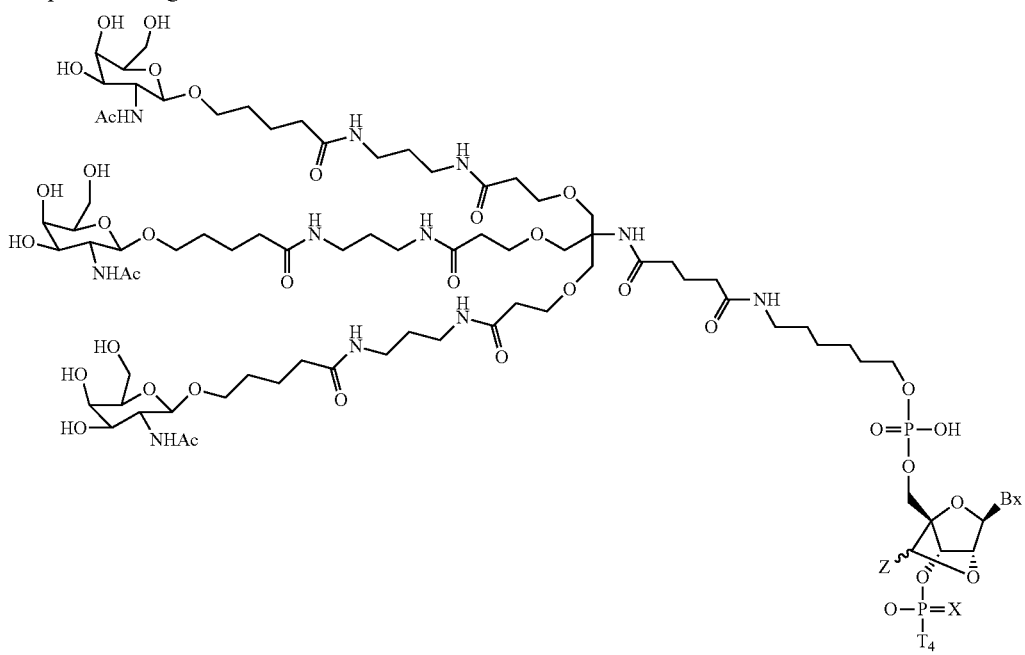

wherein X is O or S;
wherein Bx is a heterocyclic base moiety;
wherein Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, or substituted amide; and
wherein $T_4$ is a nucleoside, a monomeric subunit, or an oligomeric compound.

Embodiment 1473

A compound having the formula:

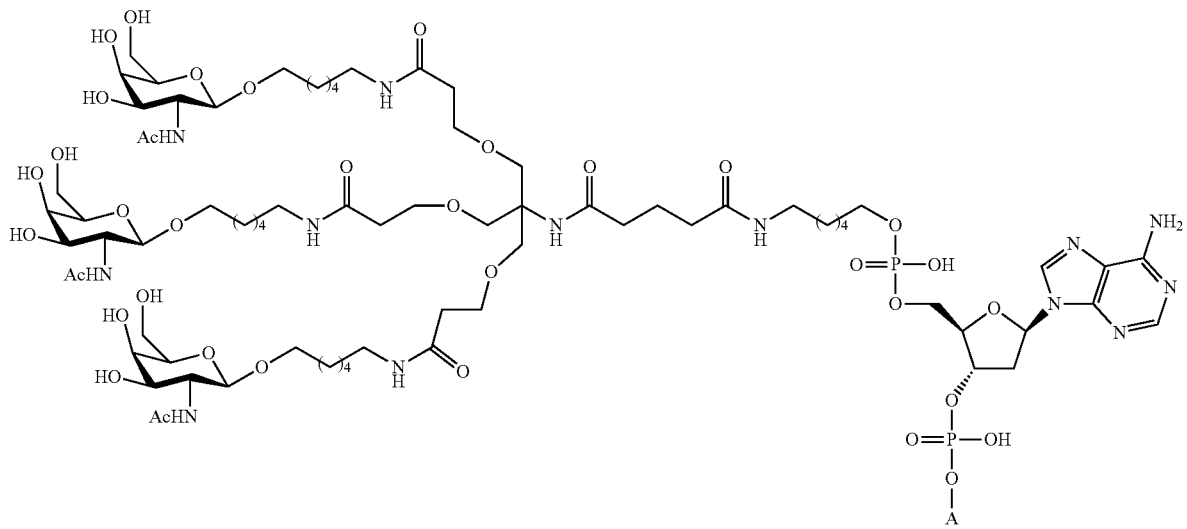

, and wherein A is the modified oligonucleotide.

Embodiment 1474

A compound having the formula (V):

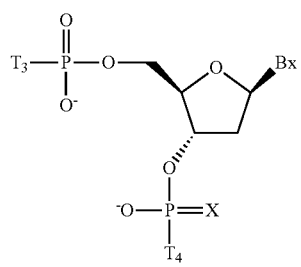

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a.

and the other of $T_3$ or $T_4$ is selected from among: a hydroxyl, a hydroxyl protecting group, a nucleoside, an oligonucleotide, a monomeric subunit, or an oligomeric compound; and wherein Bx is a heterocyclic base moiety;
and where X is selected from among O or S.

Embodiment 1475

A compound having the formula (Va):

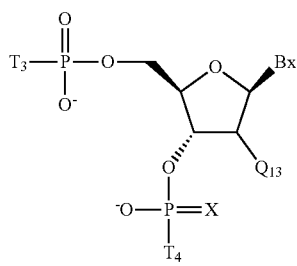

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a, and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety; and wherein $Q_{13}$ is selected from among: a halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—O($CH_2)_2$—N($CH_3)_2$, $OCH_2C(=O)$—N(H)$CH_3$, $OCH_2C(=O)$—N(H)—$(CH_2)_2$—N($CH_3)_2$, and $OCH_2$—N(H)—C(=NH)$NH_2$;
and where X is selected from among O or S.

Embodiment 1476

A compound having the formula:

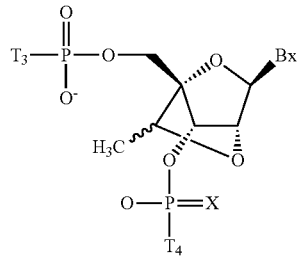

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety;

and where X is selected from among O or S.

Embodiment 1477

A compound having the formula:

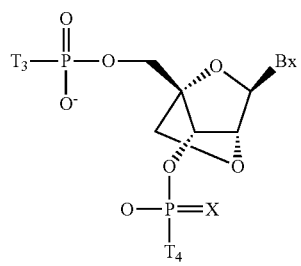

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety;

and where X is selected from among O or S.

Embodiment 1478

A compound having the formula:

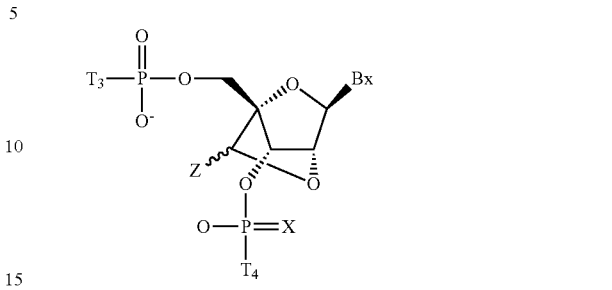

wherein Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, halogen, acyl, substituted acyl, substituted amide, thiol or substituted thio;

one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety;

and where X is selected from among O or S.

Embodiment 1479

A compound having the formula:

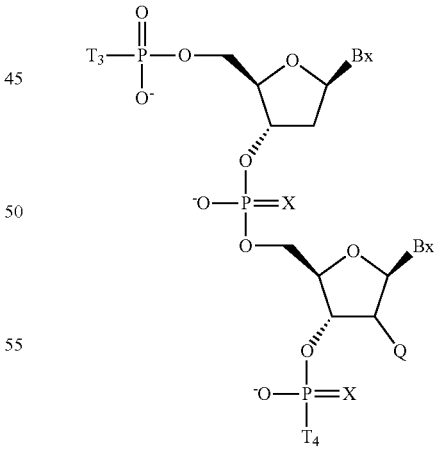

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; and wherein Bx is a heterocyclic base moiety;

and wherein Q is selected from among: a hydrogen, halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—O$(CH_2)_2$—$N(CH_3)_2$, $OCH_2C(=O)$—$N(H)CH_3$, $OCH_2C(=O)$—N(H)—$(CH_2)_2$—$N(CH_3)_2$, and $OCH_2$—N(H)—C(=NH)$NH_2$;

and where X is selected from among O or S.

Embodiment 1480

A compound having the formula:

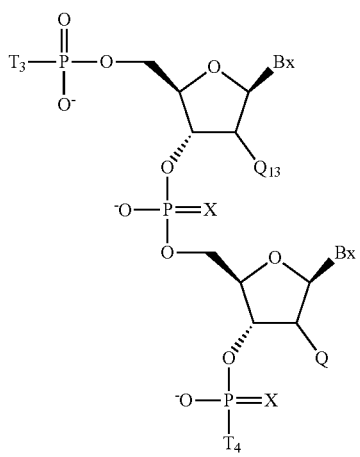

wherein one of $T_3$ or $T_4$ is selected from among: $GalNAc_3$-1a, $GalNAc_3$-2a, $GalNAc_3$-3a, $GalNAc_3$-4a, $GalNAc_3$-5a, $GalNAc_3$-6a, $GalNAc_3$-7a, $GalNAc_3$-8a, $GalNAc_3$-9a, $GalNAc_3$-10a, $GalNAc_3$-11a, $GalNAc_3$-12a, $GalNAc_3$-13a, $GalNAc_3$-14a, $GalNAc_3$-15a, $GalNAc_3$-16a, $GalNAc_3$-17a, $GalNAc_3$-18a, $GalNAc_3$-19a, $GalNAc_3$-20a, $GalNAc_3$-21a, $GalNAc_3$-22a, $GalNAc_3$-23a, GalNAc-24a, GalNAc-25a, GalNAc-26a, GalNAc-27a, GalNAc-28a, GalNAc-29a, GalNAc-30a, GalNAc-31a, and GalNAc-32a, and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety; and wherein Q or $Q_{13}$ is selected from among: a hydrogen, halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—$O(CH_2)_2$—$N(CH_3)_2$, $OCH_2C(=O)$—$N(H)CH_3$, $OCH_2C(=O)$—N(H)—$(CH_2)_2$—$N(CH_3)_2$, and $OCH_2$—N(H)—C(=NH)$NH_2$; and where X is selected from among O or S.

Embodiment 1481

A compound having the formula:

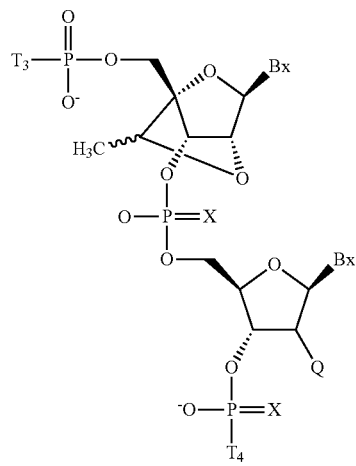

wherein one of $T_3$ or $T_4$ is selected from among: $GalNAc_3$-1a, $GalNAc_3$-2a, $GalNAc_3$-3a, $GalNAc_3$-4a, $GalNAc_3$-5a, $GalNAc_3$-6a, $GalNAc_3$-7a, $GalNAc_3$-8a, $GalNAc_3$-9a, $GalNAc_3$-10a, $GalNAc_3$-11a, $GalNAc_3$-12a, $GalNAc_3$-13a, $GalNAc_3$-14a, $GalNAc_3$-15a, $GalNAc_3$-16a, $GalNAc_3$-17a, $GalNAc_3$-18a, $GalNAc_3$-19a, $GalNAc_3$-20a, $GalNAc_3$-21a, $GalNAc_3$-22a, $GalNAc_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety;

and wherein Q is selected from among: a hydrogen, halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—O$(CH_2)_2$—$N(CH_3)_2$, $OCH_2C(=O)$—$N(H)CH_3$, $OCH_2C(=O)$—N(H)—$(CH_2)_2$—$N(CH_3)_2$, and $OCH_2$—N(H)—C(=NH)$NH_2$;

and where X is selected from among O or S.

Embodiment 1482

A compound having the formula:

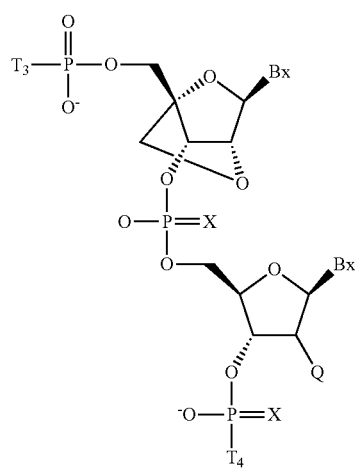

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety;

and wherein Q is selected from among: a hydrogen, halogen, $OCH_3$, $OCF_3$, $OCH_2CH_3$, $OCH_2CF_3$, $OCH_2$—$CH$=$CH_2$, $O(CH_2)_2$—$OCH_3$ (MOE), $O(CH_2)_2$—O$(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$;

and where X is selected from among O or S.

Embodiment 1483

A compound having the formula:

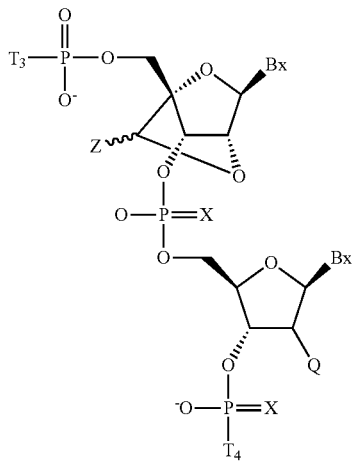

wherein Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, halogen, acyl, substituted acyl, substituted amide, thiol or substituted thio;

one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety;

and wherein Q is selected from among: a hydrogen, halogen, $OCH_3$, $OCF_3$, $OCH_2CH_3$, $OCH_2CF_3$, $OCH_2$—$CH$=$CH_2$, $O(CH_2)_2$—$OCH_3$ (MOE), $O(CH_2)_2$—O$(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$;

and where X is selected from among O or S.

Embodiment 1484

A compound having the formula:

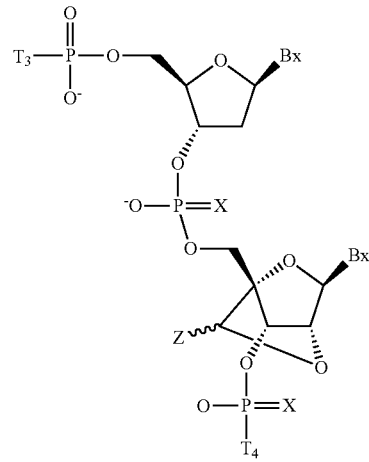

wherein one of $T_3$ or $T_4$ is selected from among: GalNAc$_3$-1a, GalNAc$_3$-2a, GalNAc$_3$-3a, GalNAc$_3$-4a, GalNAc$_3$-5a, GalNAc$_3$-6a, GalNAc$_3$-7a, GalNAc$_3$-8a, GalNAc$_3$-9a, GalNAc$_3$-10a, GalNAc$_3$-11a, GalNAc$_3$-12a, GalNAc$_3$-13a, GalNAc$_3$-14a, GalNAc$_3$-15a, GalNAc$_3$-16a, GalNAc$_3$-17a, GalNAc$_3$-18a, GalNAc$_3$-19a, GalNAc$_3$-20a, GalNAc$_3$-21a, GalNAc$_3$-22a, GalNAc$_3$-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of $T_3$ or $T_4$ is selected from among: a hydroxyl, a hydroxyl protecting group, a nucleoside, an oligonucleotide, a monomeric subunit, or an oligomeric compound; wherein Bx is a heterocyclic base moiety;

and where X is selected from among O or S and where Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, halogen, hydrogen, acyl, substituted acyl, substituted amide, thiol or substituted thio.

Embodiment 1485

A compound having the formula:

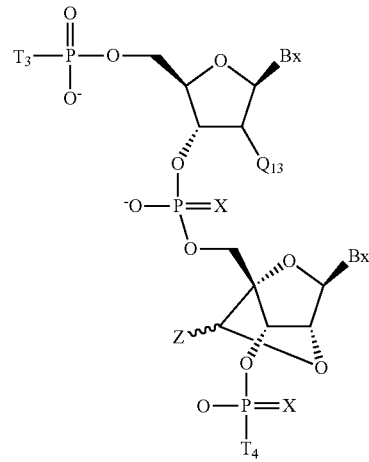

wherein one of T₃ or T₄ is selected from among: GalNAc₃-1a, GalNAc₃-2a, GalNAc₃-3a, GalNAc₃-4a, GalNAc₃-5a, GalNAc₃-6a, GalNAc₃-7a, GalNAc₃-8a, GalNAc₃-9a, GalNAc₃-10a, GalNAc₃-11a, GalNAc₃-12a, GalNAc₃-13a, GalNAc₃-14a, GalNAc₃-15a, GalNAc₃-16a, GalNAc₃-17a, GalNAc₃-18a, GalNAc₃-19a, GalNAc₃-20a, GalNAc₃-21a, GalNAc₃-22a, GalNAc₃-23a, GalNAc-24a, GalNAc-25a, GalNAc-26a, GalNAc-27a, GalNAc-28a, GalNAc-29a, GalNAc-30a, GalNAc-31a, and GalNAc-32a; and the other of T₃ or T₄ is selected from among: a hydroxyl, a hydroxyl protecting group, a nucleoside, an oligonucleotide, a monomeric subunit, or an oligomeric compound; wherein Bx is a heterocyclic base moiety; and wherein $Q_{13}$ is selected from among: a hydrogen, halogen, $OCH_3$, $OCF_3$, $OCH_2CH_3$, $OCH_2CF_3$, $OCH_2-CH=CH_2$, $O(CH_2)_2-OCH_3$ (MOE), $O(CH_2)_2-O(CH_2)_2-N(CH_3)_2$, $OCH_2C(=O)-N(H)CH_3$, $OCH_2C(=O)-N(H)-(CH_2)_2-N(CH_3)_2$, and $OCH_2-N(H)-C(=NH)NH_2$;

and where X is selected from among O or S and where Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, halogen, hydrogen, acyl, substituted acyl, substituted amide, thiol or substituted thio.

Embodiment 1486

A compound having the formula:

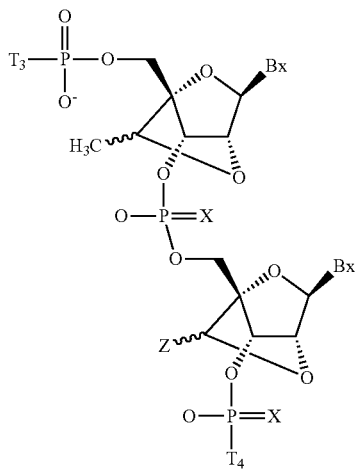

wherein one of T₃ or T₄ is selected from among: GalNAc₃-1a, GalNAc₃-2a, GalNAc₃-3a, GalNAc₃-4a, GalNAc₃-5a, GalNAc₃-6a, GalNAc₃-7a, GalNAc₃-8a, GalNAc₃-9a, GalNAc₃-10a, GalNAc₃-11a, GalNAc₃-12a, GalNAc₃-13a, GalNAc₃-14a, GalNAc₃-15a, GalNAc₃-16a, GalNAc₃-17a, GalNAc₃-18a, GalNAc₃-19a, GalNAc₃-20a, GalNAc₃-21a, GalNAc₃-22a, GalNAc₃-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of T₃ or T₄ is selected from among: a hydroxyl, a hydroxyl protecting group, a nucleoside, an oligonucleotide, a monomeric subunit, or an oligomeric compound; wherein Bx is a heterocyclic base moiety;

and where X is selected from among O or S and where Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, halogen, hydrogen, acyl, substituted acyl, substituted amide, thiol or substituted thio.

Embodiment 1487

A compound having the formula:

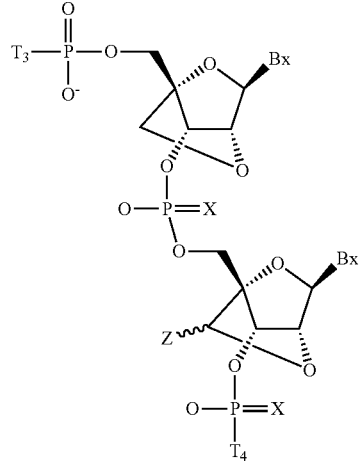

wherein one of T₃ or T₄ is selected from among: GalNAc₃-1a, GalNAc₃-2a, GalNAc₃-3a, GalNAc₃-4a, GalNAc₃-5a, GalNAc₃-6a, GalNAc₃-7a, GalNAc₃-8a, GalNAc₃-9a, GalNAc₃-10a, GalNAc₃-11a, GalNAc₃-12a, GalNAc₃-13a, GalNAc₃-14a, GalNAc₃-15a, GalNAc₃-16a, GalNAc₃-17a, GalNAc₃-18a, GalNAc₃-19a, GalNAc₃-20a, GalNAc₃-21a, GalNAc₃-22a, GalNAc₃-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of T₃ or T₄ is selected from among: a hydroxyl, a hydroxyl protecting group, a nucleoside, an oligonucleotide, a monomeric subunit, or an oligomeric compound; wherein Bx is a heterocyclic base moiety;

and where X is selected from among O or S, and where Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, halogen, hydrogen, acyl, substituted acyl, substituted amide, thiol or substituted thio.

Embodiment 1488

A compound having the formula:

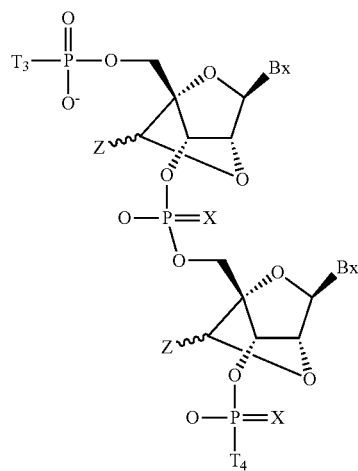

wherein Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio;

one of T₃ or T₄ is selected from among: GalNAc₃-1a, GalNAc₃-2a, GalNAc₃-3a, GalNAc₃-4a, GalNAc₃-5a, GalNAc₃-6a, GalNAc₃-7a, GalNAc₃-8a, GalNAc₃-9a, Gal- NAc₃-10a, GalNAc₃-11a, GalNAc₃-12a, GalNAc₃-13a, GalNAc₃-14a, GalNAc₃-15a, GalNAc₃-16a, GalNAc₃-17a, GalNAc₃-18a, GalNAc₃-19a, GalNAc₃-20a, GalNAc₃-21a, GalNAc₃-22a, GalNAc₃-23a, GalNAc-24a, GalNAc-25a, GalNAc-26a, GalNAc-27a, GalNAc-28a, GalNAc-29a, GalNAc-30a, GalNAc-31a, and GalNAc-32a;

and the other of T₃ or T₄ is selected from among: a hydroxyl, a hydroxyl protecting group, a nucleoside, an oligonucleotide, a monomeric subunit, or an oligomeric compound; wherein Bx is a heterocyclic base moiety;

and where X is O or S;

and where Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, halogen, hydrogen, acyl, substituted acyl, substituted amide, thiol or substituted thio.

Embodiment 1489

The compound of any of embodiments 1474 to 1488, wherein $B_x$ is selected from adenine, guanine, thymine, uracil, cytosine, or 5-methyl cytosine.

Embodiment 1490

The compound of any of embodiments 1474 to 1483 or 1485, wherein Q or $Q_{13}$ is $O(CH_2)_2$—$OCH_3$.

Embodiment 1491

A compound having the formula (XVI):

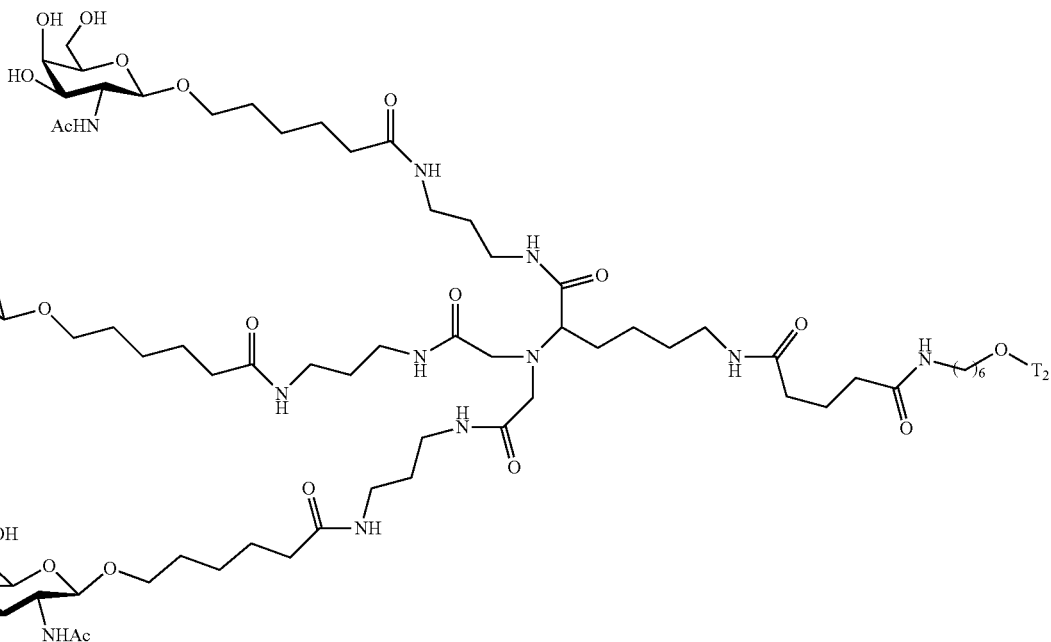

wherein:
T₂ is a nucleoside, a nucleotide, a monomeric subunit, or an oligomeric compound.

Embodiment 1492

A compound having the formula (XVII):

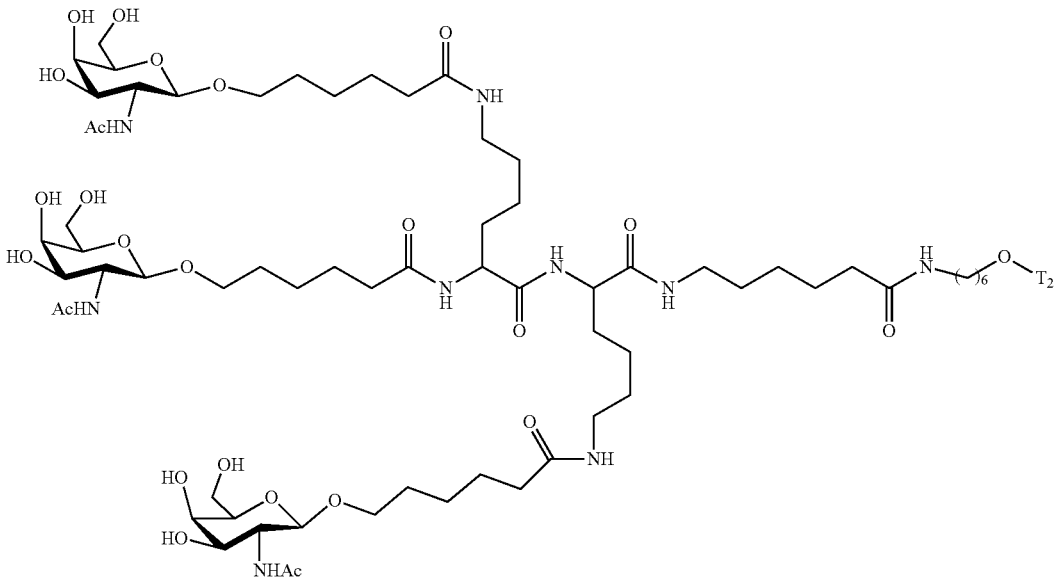

wherein:
   T₂ is a nucleoside, a nucleotide, a monomeric subunit, or an oligomeric compound.
Embodiment 1493
A compound having the formula (XVIII):
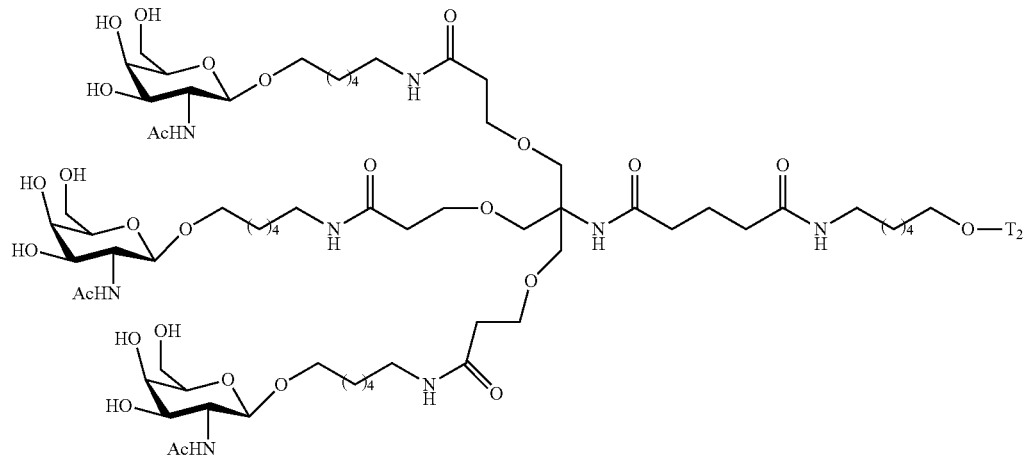
wherein:
   T₂ is a nucleoside, a nucleotide, a monomeric subunit, or an oligomeric compound.
Embodiment 1494
A compound having the formula (XIX):
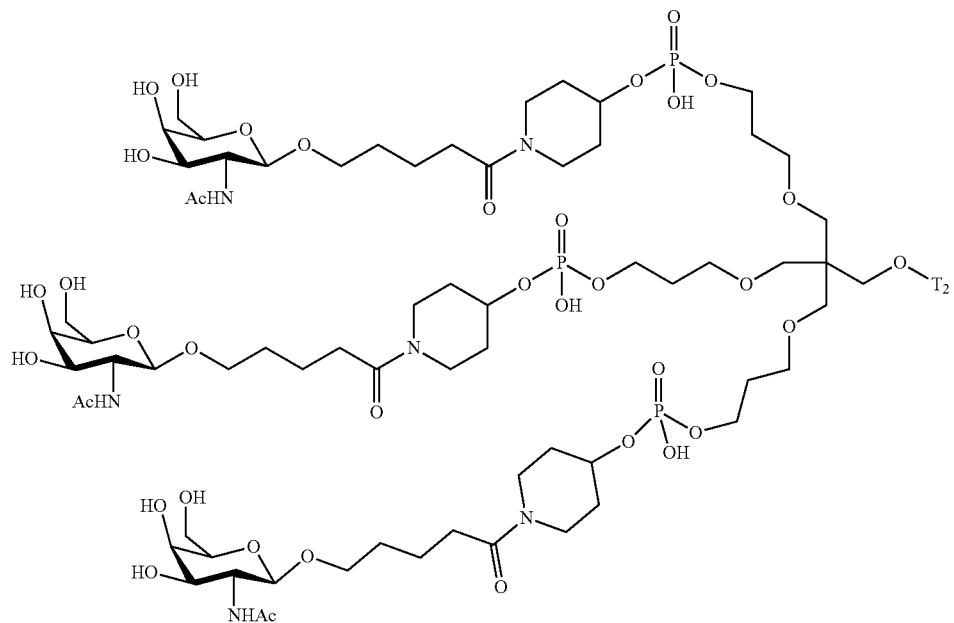
wherein:
   T₂ is a nucleoside, a nucleotide, a monomeric subunit, or an oligomeric compound.

Embodiment 1495
A compound having the formula (XX):
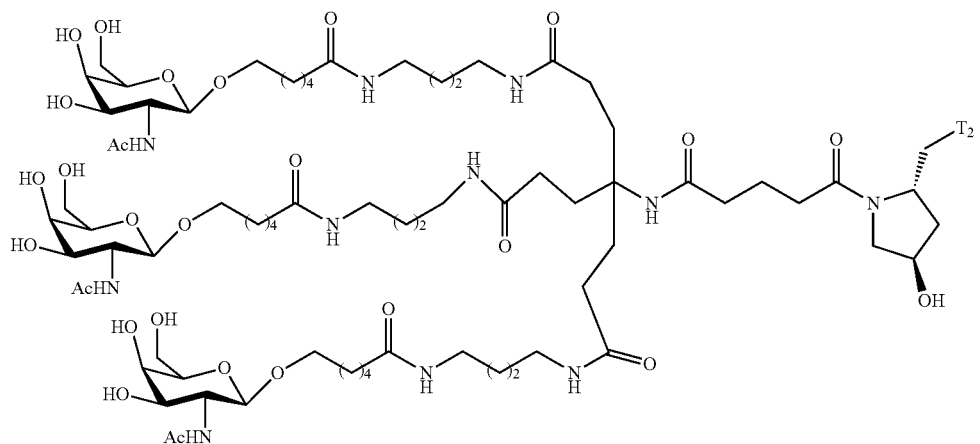
wherein:
T₂ is a group comprising a nucleoside, a nucleotide, a monomeric subunit, or an oligomeric compound.
Embodiment 1496
A compound having the formula (XXI):
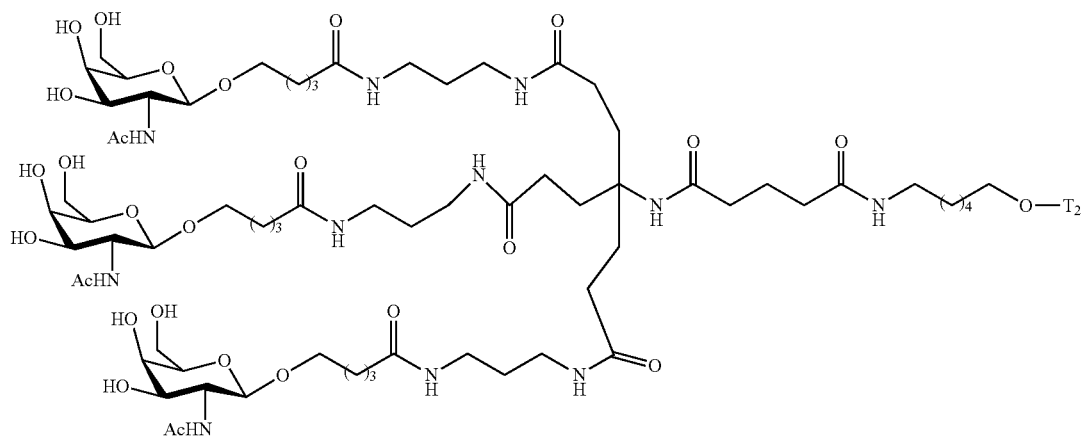
wherein:
T₂ is a nucleoside, a nucleotide, a monomeric subunit, or an oligomeric compound.

Embodiment 1497

A compound having the formula (XXII):

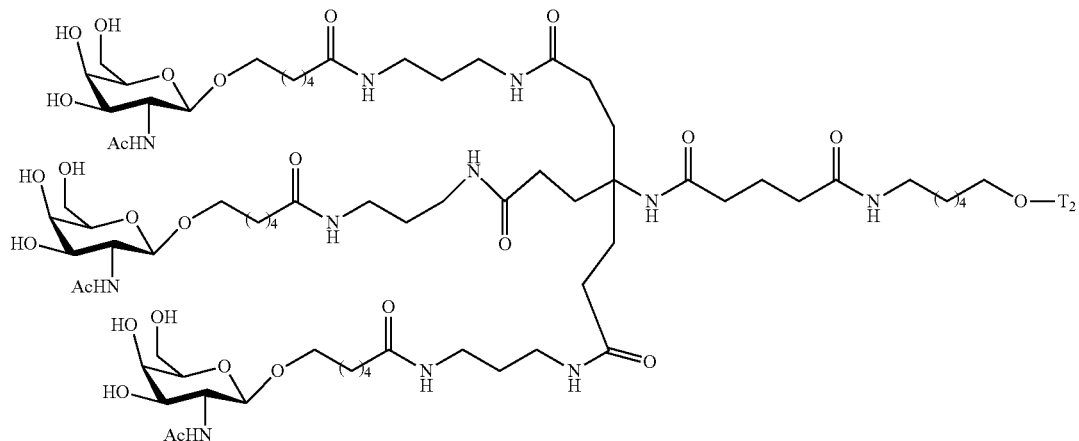

wherein:

T₂ is a nucleoside, a nucleotide, a monomeric subunit, or an oligomeric compound.

Embodiment 1498

A compound having the formula (XXIII):

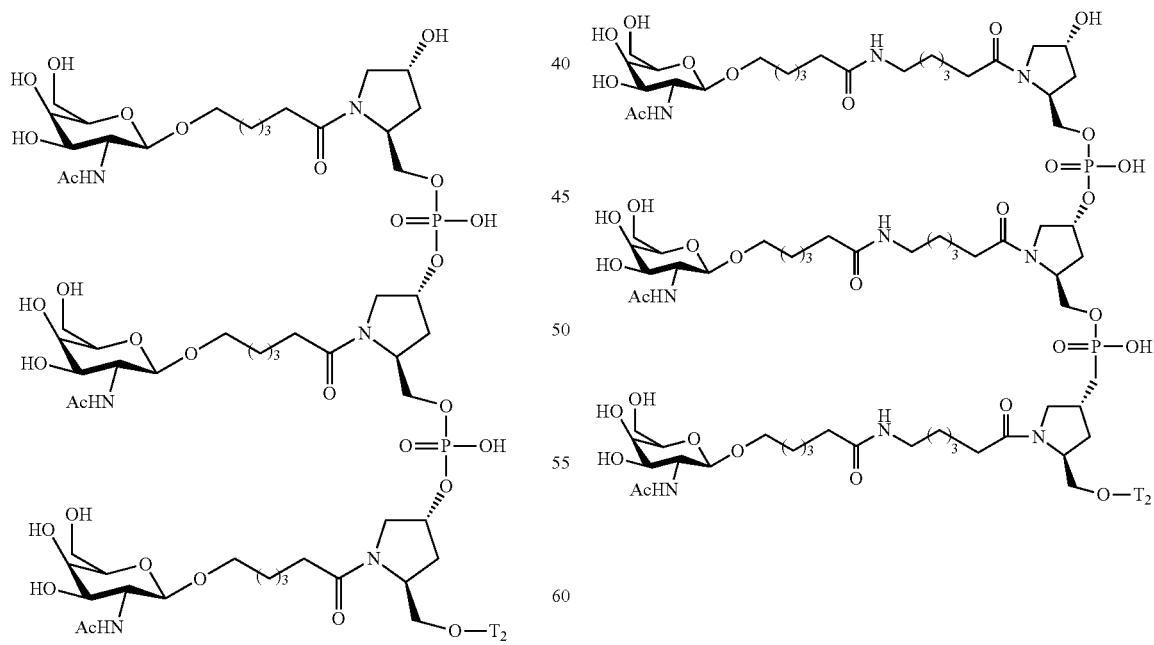

wherein:

T₂ is a group comprising a nucleoside, a nucleotide, a monomeric subunit, or an oligomeric compound.

Embodiment 1499

A compound having the formula (XXIIIa):

wherein:

T₂ is a group comprising a nucleoside, a nucleotide, a monomeric subunit, or an oligomeric compound.

Embodiment 1500

A compound having the formula (XXIV):

[Chemical structure of formula (XXIV) showing three GalNAc (N-acetylgalactosamine) sugar units each connected via an O-(CH₂)₃-C(=O)-N linker to a branched structure with phosphate groups (O=P-OH) linking to O-T₂]

wherein:
T₂ is a group comprising a nucleoside, a nucleotide, a monomeric subunit, or an oligomeric compound.

Embodiment 1501

A compound having the formula (XXIVa):

[Chemical structure of formula (XXIVa) showing three GalNAc sugar units each connected via an O-(CH₂)₃-C(=O)-NH-(CH₂)₃-C(=O)-N linker with phosphate groups linking to O-T₂]

wherein:
T₂ is a group comprising a nucleoside, a nucleotide, a monomeric subunit, or an oligomeric compound.

Embodiment 1502

The compound of any of embodiments 1432 to 1502, wherein the oligomeric compound is a modified oligonucleotide.

Embodiment 1503

The compound of embodiment 1502, wherein the modified oligonucleotide is a gapmer.

Embodiment 1504

The compound of embodiment 1502, wherein the modified oligonucleotide activates RNase H when bound to a complementary target nucleic acid.

Embodiment 1505

The compound of any of embodiments 1502 to 1504, wherein the modified oligonucleotide comprises at least one modified nucleoside.

Embodiment 1506

The compound of embodiment 1505 wherein the at least one modified nucleoside comprises a modified base.

Embodiment 1507

The compound of embodiment 1505 or 1506 wherein the at least one modified nucleoside comprises a sugar surrogate.

Embodiment 1508

The compound of embodiment 1507 wherein the sugar surrogate is a tetrahydropyran.

Embodiment 1509

The compound of embodiment 1508 wherein the tetrahydropyran is F-HNA.

Embodiment 1510

The compound of any of embodiments 1505 to 1509 wherein the remainder of the modified oligonucleotide comprises at least one nucleoside comprising a modified sugar.

Embodiment 1511

The compound of embodiment any of embodiments 1502 to 1510 wherein the modified oligonucleotide comprises at least one nucleoside comprising a modified sugar.

Embodiment 1512

The compound of embodiment 1511 wherein the at least one modified nucleoside comprising a modified sugar is selected from a bicyclic nucleoside and a 2'-modified nucleoside.

Embodiment 1513

The compound of embodiment 1512 wherein the at least one modified nucleoside is a bicyclic nucleoside.

Embodiment 1514

The compound of embodiment 1513 wherein the bicyclic nucleoside is a (4'-CH₂—O-2') BNA nucleoside.

Embodiment 1515

The compound of embodiment 1513 wherein the bicyclic nucleoside is a (4'-(CH$_2$)$_2$—O-2') BNA nucleoside.

Embodiment 1516

The compound of embodiment 1513 wherein the bicyclic nucleoside is a (4'-C(CH$_3$)H—O-2') BNA nucleoside.

Embodiment 1517

The compound of embodiment 1513 wherein the at least one modified nucleoside is a 2'-modified nucleoside.

Embodiment 1518

The compound of embodiment 1512 wherein the at least one 2'-modified nucleoside is selected from a 2'-F nucleoside, a 2'-OCH$_3$ nucleoside, and a 2'-O(CH$_2$)$_2$OCH$_3$ nucleoside.

Embodiment 1519

The compound of embodiment 1518 wherein the at least one 2'-modified nucleoside is a 2'-F nucleoside.

Embodiment 1520

The compound of embodiment 1518 wherein the at least one 2'-modified nucleoside is a 2'-OCH$_3$ nucleoside.

Embodiment 1521

The compound of embodiment 1518 wherein the at least one 2'-modified nucleoside is a 2'-O(CH$_2$)$_2$OCH$_3$ nucleoside.

Embodiment 1522

The compound of any of embodiments 1502 to 1521 wherein the modified oligonucleotide comprises at least one unmodified nucleoside.

Embodiment 1523

The compound of embodiment 1522 wherein the unmodified nucleoside is a ribonucleoside.

Embodiment 1524

The compound of embodiment 1522 wherein the unmodified nucleoside is a deoxyribonucleoside.

Embodiment 1525

The compound of any of embodiments 1502 to 1524 wherein the modified oligonucleotide comprises at least two modified nucleosides.

Embodiment 1526

The compound of embodiment 1525 wherein the at least two modified nucleosides comprise the same modification.

Embodiment 1527

The compound of embodiment 1525 wherein the at least two modified nucleosides comprise different modifications.

Embodiment 1528

The compound of any of embodiments 1525 to 1527 wherein at least one of the at least two modified nucleosides comprises a sugar surrogate.

Embodiment 1529

The compound of any of embodiments 1525 to 1528 wherein at least one of the at least two modified nucleosides comprises a 2'-modification.

Embodiment 1530

The compound of embodiment 1529 wherein each of the at least two modified nucleosides is independently selected from 2'-F nucleosides, 2'-OCH$_3$ nucleosides and 2'-O(CH$_2$)$_2$OCH$_3$ nucleosides.

Embodiment 1531

The compound of embodiment 1530 wherein each of the at least two modified nucleosides is a 2'-F nucleoside.

Embodiment 1532

The compound of embodiment 1530 wherein each of the at least two modified nucleosides is a 2'-OCH$_3$ nucleosides.

Embodiment 1533

The compound of embodiment 1530 wherein each of the at least two modified nucleosides are a 2'-O(CH$_2$)$_2$OCH$_3$ nucleoside.

Embodiment 1534

The compound of any of embodiments 1502 to 1533, wherein essentially every nucleoside of the modified oligonucleotide is a modified nucleoside.

Embodiment 1535

The compound of any of embodiments 1502 to 1522 or 1525 to 1534 wherein every nucleoside of the modified oligonucleotide is a modified nucleoside.

Embodiment 1536

The compound of any of embodiments 1502 to 1533, wherein at least 4 nucleosides of the modified oligonucleotide are deoxyribonucleosides.

Embodiment 1537

The compound of any of embodiments 1520 to 1533, wherein at least 5 nucleosides of the modified oligonucleotide are deoxyribonucleosides.

Embodiment 1538

The compound of any of embodiments 1502 to 1533, wherein at least 6 nucleosides of the modified oligonucleotide are deoxyribonucleosides.

Embodiment 1539

The compound of any of embodiments 1502 to 1533, wherein at least 7 nucleosides of the modified oligonucleotide are deoxyribonucleosides.

Embodiment 1540

The compound of any of embodiments 1502 to 1533, wherein at least 8 nucleosides of the modified oligonucleotide are deoxyribonucleosides.

Embodiment 1541

The compound of any of embodiments 1502 to 1533, wherein at least 9 nucleosides of the modified oligonucleotide are deoxyribonucleosides.

Embodiment 1542

The compound of any of embodiments 1502 to 1533, wherein at least 10 nucleosides of the modified oligonucleotide are deoxyribonucleosides.

Embodiment 1543

The compound of any of embodiments 1536 to 1542, wherein each of the deoxyribonucleosides of the modified oligonucleotide are consecutively linked by internucleoside linkages.

Embodiment 1544

The compound of any of embodiments 1502 to 1543, wherein the modified oligonucleotide is single-stranded.

Embodiment 1545

The compound of any of embodiments 1502 to 1543, wherein the modified oligonucleotide is double-stranded.

Embodiment 1546

The compound of any of embodiments 1502 to 1543, wherein the modified oligonucleotide is an antisense compound.

Embodiment 1547

The compound of any of embodiments 1502 to 1543, wherein the modified oligonucleotide is a RISC based oligonucleotide.

Embodiment 1548

The compound of any of embodiments 1502 to 1543, wherein the modified oligonucleotide activates the RISC pathway.

Embodiment 1549

The compound of any of embodiments 1502 to 1547, wherein the oligonucleotide is an RNase H based antisense compound.

Embodiment 1550

The compound of any of embodiments 1502 to 1534 or 1536 to 1546, wherein the compound has a sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 1551

The compound of embodiment 1550, wherein the 5'-region consists of 2 linked 5'-region nucleosides.

Embodiment 1552

The compound of embodiment 1550, wherein the 5'-region consists of 3 linked 5'-region nucleosides.

Embodiment 1553

The compound of embodiment 1550, wherein the 5'-region consists of 4 linked 5'-region nucleosides.

Embodiment 1554

The compound of embodiment 1550, wherein the 5'-region consists of 5 linked 5'-region nucleosides.

Embodiment 1555

The compound of any of embodiments 1550 to 1554, wherein the 3'-region consists of 2 linked 3'-region nucleosides.

Embodiment 1556

The compound of any of embodiments 1550 to 1554, wherein the 3'-region consists of 3 linked 3'-region nucleosides.

Embodiment 1557

The compound of any of embodiments 1550 to 1554, wherein the 3'-region consists of 4 linked 3'-region nucleosides.

Embodiment 1558

The compound of any of embodiments 1550 to 1554, wherein the 3'-region consists of 5 linked 3'-region nucleosides.

Embodiment 1559

The compound of any of embodiments 1550 to 1558, wherein the central region consists of 5 linked central region nucleosides.

Embodiment 1560

The compound of any of embodiments 1550 to 1558, wherein the central region consists of 6 linked central region nucleosides.

Embodiment 1561

The compound of any of embodiments 1550 to 1558, wherein the central region consists of 7 linked central region nucleosides.

Embodiment 1562

The compound of any of embodiments 1550 to 1558, wherein the central region consists of 8 linked central region nucleosides.

Embodiment 1563

The compound of any of embodiments 1550 to 1558, wherein the central region consists of 9 linked central region nucleosides.

Embodiment 1564

The compound of any of embodiments 1550 to 1558, wherein the central region consists of 10 linked central region nucleosides.

Embodiment 1565

The compound of any of embodiments 1550 to 1564, wherein the compound consists of 14 to 26 linked nucleosides.

Embodiment 1566

The compound of any of embodiments 1550 to 1564, wherein the compound consists of 15 to 25 linked nucleosides.

Embodiment 1567

The compound of any of embodiments 1550 to 1564, wherein the compound consists of 16 to 20 linked nucleosides.

Embodiment 1568

The compound of any of embodiments 1550 to 1567, wherein each modified nucleoside independently comprises a 2'-substituted sugar moiety or a bicyclic sugar moiety.

Embodiment 1569

The compound of embodiment 1568, wherein the at least one modified nucleoside comprises a 2'-substituted sugar moiety.

Embodiment 1570

The compound of embodiment 1569, wherein each modified nucleoside comprising a 2'-substituted sugar moiety comprises a 2' substituent independently selected from among: halogen, optionally substituted allyl, optionally substituted amino, azido, optionally substituted SH, CN, OCN, CF3, OCF3, O, S, or N(Rm)-alkyl; O, S, or N(Rm)-alkenyl; O, S or N(Rm)-alkynyl; optionally substituted O-alkylenyl-O-alkyl, optionally substituted alkynyl, optionally substituted alkaryl, optionally substituted aralkyl, optionally substituted O-alkaryl, optionally substituted O-aralkyl, O(CH2)2SCH3, O—(CH2)2-O—N(Rm)(Rn) or O—$CH_2$—C(=O)—N(Rm)(Rn), where each Rm and Rn is, independently, H, an amino protecting group or substituted or unsubstituted $C_1$-$C_{10}$ alkyl;

wherein each optionally substituted group is optionally substituted with a substituent group independently selected from among: hydroxyl, amino, alkoxy, carboxy, benzyl, phenyl, nitro ($NO_2$), thiol, thioalkoxy (S-alkyl), halogen, alkyl, aryl, alkenyl and alkynyl.

Embodiment 1571

The compound of embodiment 1569, wherein each 2' substituent is independently selected from among: a halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—CH=$CH_2$, $O(CH_2)_2$—$OCH_3$, $O(CH_2)_2$—$SCH_3$, $O(CH_2)_2$—$OCF_3$, $O(CH_2)_3$—$N(R_1)(R_2)$, $O(CH_2)_2$—$ON(R_1)(R_2)$, $O(CH_2)_2$—$O(CH_2)_2$—$N(R_1)(R_2)$, $OCH_2C(=O)$—$N(R_1)(R_2)$, $OCH_2C(=O)$—$N(R_3)$—$(CH_2)_2$—$N(R_1)(R_2)$, and $O(CH_2)_2$—$N(R_3)$—C(=$NR_4$)[$N(R_1)(R_2)$]; wherein $R_1$, $R_2$, $R_3$ and $R_4$ are each, independently, H or $C_1$-$C_6$ alkyl.

Embodiment 1572

The compound of embodiment 1569, wherein each 2' substituent is independently selected from among: a halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—O($CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—N(H)—C(=NH)$NH_2$.

Embodiment 1573

The compound of embodiment 1569, wherein the at least one 2'-modified nucleoside comprises a 2'-MOE sugar moiety.

Embodiment 1574

The compound of embodiment 1569, wherein the at least one 2'-modified nucleoside comprises a 2'-OMe sugar moiety.

Embodiment 1575

The compound of embodiment 1569, wherein the at least one 2'-modified nucleoside comprises a 2'-F sugar moiety.

Embodiment 1576

The compound of any of embodiments 1550 to 1575, wherein the compound comprises at least one modified nucleoside comprising a sugar surrogate.

Embodiment 1577

The compound of embodiment 1576, wherein the modified nucleoside comprises an F-HNA sugar moiety.

Embodiment 1578

The compound of embodiment 1576, wherein the modified nucleoside comprises an HNA sugar moiety.

Embodiment 1579

The compound of any of embodiments 1550 to 1578 wherein the compound comprises at least one modified nucleoside comprising a bicyclic sugar moiety.

Embodiment 1580

The compound of embodiment 1579, wherein the bicyclic sugar moiety is a cEt sugar moiety.

Embodiment 1581

The compound of embodiment 1579, wherein bicyclic sugar moiety is an LNA sugar moiety.

Embodiment 1582

The compound of any of embodiments 1502 to 1581, wherein the compound comprises at least one modified internucleoside linkage.

Embodiment 1583

The compound of embodiment 1582, wherein each internucleoside linkage of the compound is a modified internucleoside linkage.

Embodiment 1584

The compound of embodiment 1582, wherein the compound comprises at least one modified linkage and at least one unmodified phosphodiester internucleoside linkage.

Embodiment 1585

The compound of any of embodiments 1582 or 1584 wherein at least one modified internucleoside linkage is a phosphosphorothioate internucleoside linkage.

Embodiment 1586

The compound of any of embodiments 1584 or 1585, wherein each modified internucleoside linkage is a phosphorothioate internucleoside linkage.

Embodiment 1587

The compound of any of embodiments 1584 or 1585, wherein the compound comprises at least 2 phosphodiester internucleoside linkages.

Embodiment 1588

The compound of any of embodiments 1584 or 1585, wherein the compound comprises at least 3 phosphodiester internucleoside linkages.

Embodiment 1589

The compound of any of embodiments 1584 or 1585, wherein the compound comprises at least 4 phosphodiester internucleoside linkages.

Embodiment 1590

The compound of any of embodiments 1584 or 1585, wherein the compound comprises at least 5 phosphodiester internucleoside linkages.

Embodiment 1591

The compound of any of embodiments 1584 or 1585, wherein the compound comprises at least 6 phosphodiester internucleoside linkages.

Embodiment 1592

The compound of any of embodiments 1584 or 1585, wherein the compound comprises at least 7 phosphodiester internucleoside linkages.

Embodiment 1593

The compound of any of embodiments 1584 or 1585, wherein the compound comprises at least 8 phosphodiester internucleoside linkages.

Embodiment 1594

The compound of any of embodiments 1584 or 1585, wherein the compound comprises at least 9 phosphodiester internucleoside linkages.

Embodiment 1595

The compound of any of embodiments 1584 or 1585, wherein the compound comprises at least 10 phosphodiester internucleoside linkages.

Embodiment 1596

The compound of any of embodiments 1584 or 1595, wherein the compound comprises fewer than 16 phosphorothioate internucleoside linkages.

Embodiment 1597

The compound of any of embodiments 1584 or 1595, wherein the compound comprises fewer than 15 phosphorothioate internucleoside linkages.

Embodiment 1598

The compound of any of embodiments 1584 or 1595, wherein the compound comprises fewer than 14 phosphorothioate internucleoside linkages.

Embodiment 1599

The compound of any of embodiments 1584 or 1595, wherein the compound comprises fewer than 13 phosphorothioate internucleoside linkages.

Embodiment 1600

The compound of any of embodiments 1584 or 1595, wherein the compound comprises fewer than 12 phosphorothioate internucleoside linkages.

Embodiment 1601

The compound of any of embodiments 1584 or 1595, wherein the compound comprises fewer than 11 phosphorothioate internucleoside linkages.

Embodiment 1602

The compound of any of embodiments 1584 or 1595, wherein the compound comprises fewer than 10 phosphorothioate internucleoside linkages.

Embodiment 1603

The compound of any of embodiments 1584 or 1595, wherein the compound comprises fewer than 9 phosphorothioate internucleoside linkages.

Embodiment 1604

The compound of any of embodiments 1584 or 1595, wherein the compound comprises fewer than 8 phosphorothioate internucleoside linkages.

Embodiment 1605

The compound of any of embodiments 1584 or 1595, wherein the compound comprises fewer than 7 phosphorothioate internucleoside linkages.

Embodiment 1606

The compound of any of embodiments 1584 or 1595, wherein the compound comprises fewer than 6 phosphorothioate internucleoside linkages.

Embodiment 1607

The compound of any of embodiments 1502 to 1605, wherein each terminal internucleoside linkage of the compound is a phosphorothioate internucleoside linkage.

Embodiment 1608

The compound of any of embodiments 1502 to 1605, wherein each internucleoside linkage linking two deoxynucleosides of the compound is a phosphorothioate internucleoside linkage.

Embodiment 1609

The compound of any of embodiments 1502 to 1605, wherein each non-terminal internucleoside linkage linking two modified nucleosides of the compound is a phosphodiester internucleoside linkage.

Embodiment 1610

The compound of any of embodiments 1502 to 1605, wherein each non-terminal internucleoside linkage of the compound that is 3' of a modified nucleoside is a phosphodiester internucleoside linkage.

Embodiment 1611

The compound of any of embodiments 1502 to 1605, wherein each internucleoside linkage of the compound that is 3' of a deoxynucleoside is a phosphorothioate internucleoside linkage.

Embodiment 1612

The compound of any of embodiments 1502 to 1588, wherein the compound has a chemical motif selected from among:

MsMy(Ds)$_{0-1}$(DsDs)$_{(3-5)}$MsM
MsMy(Ds)$_{0-1}$(DsDs)$_{(3-5)}$MyMsM
MsMy(Ds)$_{0-1}$(DsDs)$_{(3-5)}$MyMyMsM
MsMy(Ds)$_{0-1}$(DsDs)$_{(3-5)}$MyMyMyMsM
MsMyMy(Ds)$_{0-1}$(DsDs)$_{(3-5)}$MsM
MsMyMy(Ds)$_{0-1}$(DsDs)$_{(3-5)}$MyMsM
MsMyMy(Ds)$_{0-1}$(DsDs)$_{(3-5)}$MyMyMsM
MsMyMy(Ds)$_{0-1}$(DsDs)$_{(3-5)}$MyMyMyMsM
MsMyMyMy(Ds)$_{0-1}$(DsDs)$_{(3-5)}$MsM
MsMyMyMy(Ds)$_{0-1}$(DsDs)$_{(3-5)}$MyMsM
MsMyMyMy(Ds)$_{0-1}$(DsDs)$_{(3-5)}$MyMyMsM
MsMyMyMy(Ds)$_{0-1}$(DsDs)$_{(3-5)}$MyMyMyMsM
MsMyMyMyMy(Ds)$_{0-1}$(DsDs)$_{(3-5)}$MsM
MsMyMyMyMy(Ds)$_{0-1}$(DsDs)$_{(3-5)}$MyMsM
MsMyMyMyMy(Ds)$_{0-1}$(DsDs)$_{(3-5)}$MyMyMsM; and
MsMyMyMyMy(Ds)$_{0-1}$(DsDs)$_{(3-5)}$MyMyMyMsM;

wherein each M is independently a modified nucleoside, each D is a deoxynucleoside; each s is a phosphorothioate internucleoside linkage, and each y is either a phosphodiester internucleoside linkage or a phosphorothioate internucleoside linkage, provided that at least one y is a phosphodiester internucleotide linkage.

Embodiment 1613

The compound of any of embodiments 1502 to 1588, wherein the compounds has a chemical motif selected from among:

MsMo(Ds)$_{0-1}$(DsDs)$_{(3-5)}$MoMsM
MsMo(Ds)$_{0-1}$(DsDs)$_{(3-5)}$MoMoMsM
MsMo(Ds)$_{0-1}$(DsDs)$_{(3-5)}$MoMoMoMsM
MsMoMo(Ds)$_{0-1}$(DsDs)$_{(3-5)}$MsM
MsMoMo(Ds)$_{0-1}$(DsDs)$_{(3-5)}$MoMsM
MsMoMo(Ds)$_{0-1}$(DsDs)$_{(3-5)}$MoMoMsM
MsMoMo(Ds)$_{0-1}$(DsDs)$_{(3-5)}$MoMoMoMsM
MsMoMoMo(Ds)$_{0-1}$(DsDs)$_{(3-5)}$MsM
MsMoMoMo(Ds)$_{0-1}$(DsDs)$_{(3-5)}$MoMsM
MsMoMoMo(Ds)$_{0-1}$(DsDs)$_{(3-5)}$MoMoMsM
MsMoMoMo(Ds)$_{0-1}$(DsDs)$_{(3-5)}$MoMoMoMsM
MsMoMoMoMo(Ds)$_{0-1}$(DsDs)$_{(3-5)}$MsM
MsMoMoMoMo(Ds)$_{0-1}$(DsDs)$_{(3-5)}$MoMsM

MsMoMoMoMo(Ds)$_{0-1}$(DsDs)$_{(3-5)}$MoMoMsM; and
MsMoMoMoMo(Ds)$_{0-1}$(DsDs)$_{(3-5)}$MoMoMoMsM;
wherein each M is independently a modified nucleoside, each D is a deoxynucleoside; each o is a phosphodiester internucleoside linkage, and each s is a phosphorothioate internucleoside linkage.

Embodiment 1614

The compound of embodiment 1612 or 1613, wherein each M is independently selected from among: a 2'-MOE nucleoside and a bicyclic nucleoside.

Embodiment 1615

The compound of embodiment 1614, wherein each M is independently selected from among a 2'-MOE nucleoside, a cEt nucleoside, and an LNA nucleoside.

Embodiment 1616

The compound of embodiment 1612 or 1613, wherein each M is a 2'-MOE nucleoside.

Embodiment 1617

The compound of embodiment 1612 or 1613, wherein each M is a cEt nucleoside.

Embodiment 1618

The compound of embodiments 1612 or 1613, wherein each M is an LNA nucleoside.

Embodiment 1619

The compound of any of embodiments 1502 to 1618, wherein the compound has a nucleobase sequence comprising an at least 8 nucleobase portion complementary to an equal length portion of a target nucleic acid.

Embodiment 1620

The compound of any of embodiments 1502 to 1618, wherein the compound has a nucleobase sequence comprising an at least 10 nucleobase portion complementary to an equal length portion of a target nucleic acid.

Embodiment 1621

The compound of any of embodiments 1502 to 1618, wherein the compound has a nucleobase sequence comprising an at least 12 nucleobase portion complementary to an equal length portion of a target nucleic acid.

Embodiment 1622

The compound of any of embodiments 1502 to 1618, wherein the compound has a nucleobase sequence comprising an at least 14 nucleobase portion complementary to an equal length portion of a target nucleic acid.

Embodiment 1623

The compound of any of embodiments 1502 to 1618, wherein the compound has a nucleobase sequence comprising an at least 16 nucleobase portion complementary to an equal length portion of a target nucleic acid.

Embodiment 1624

The compound of any of embodiments 1502 to 1618, wherein the compound has a nucleobase sequence comprising an at least 18 nucleobase portion complementary to an equal length portion of a target nucleic acid.

Embodiment 1625

The compound of any of embodiments 1502 to 1618, wherein the compound is at least 90% complementary to a target nucleic acid.

Embodiment 1626

The compound of any of embodiments 1502 to 1618, wherein the compound is at least 95% complementary to a target nucleic acid.

Embodiment 1627

The compound of any of embodiments 1502 to 1618, wherein the compound is 100% complementary to a target nucleic acid.

Embodiment 1628

The compound of embodiment 1627, wherein the target nucleic acid is a pre-mRNA.

Embodiment 1629

The compound of embodiment 1627, wherein the target nucleic acid is an mRNA.

Embodiment 1630

The compound of embodiment 1627, wherein the target nucleic acid is a micro RNA.

Embodiment 1631

The compound of embodiment 1627, wherein the target nucleic acid is expressed in the liver.

Embodiment 1632

The compound of embodiment 1627, wherein the target nucleic acid is expressed in hepatocytes.

Embodiment 1633

The compound of embodiment 1627, wherein the target nucleic encodes a protein
selected from among: Alpha 1 antitrypsin, Androgen Receptor, Apolipoprotein (a), Apolipoprotein B, Apolipoprotein C-III, C-Reactive Protein, eIF-4E, Factor VII, Factor XI, Glucocorticoid Receptor, Glucagon Receptor, Protein Tyrosine Phosphatase 1B, STAT3, SRB-1, and Transthyretin.

Embodiment 1634

The compound of embodiment 1627, wherein the target nucleic acid is a viral nucleic acid.

Embodiment 1635

The compound of embodiment 1634, wherein the viral nucleic acid expressed in the liver.

Embodiment 1636

The compound of embodiment 1634, wherein the target nucleic acid is a Hepatitis B viral nucleic acid.

Embodiment 1637

The compound of any of embodiments 1502 to 1627, wherein the compound comprises the nucleobase sequence of any one of SEQ ID NOs.: 17, 18, 19, 20, 21, 22, 23, or 24.

Embodiment 1638

The compound of any of embodiments 1502 to 1627, wherein the compound comprises the nucleobase sequence of any one of SEQ ID NO.: 25, 26, 27, 28, 29, or 30.

Embodiment 1639

The compound of any of embodiments 1502 to 1627, wherein the compound comprises the nucleobase sequence of SEQ ID NO.: 31.

Embodiment 1640

The compound of any of embodiments 1502 to 1627, wherein the compound comprises the nucleobase sequence of SEQ ID NO.: 32.

Embodiment 1641

The compound of any of embodiments 1502 to 1627, wherein the compound comprises the nucleobase sequence of SEQ ID NO.: 33.

Embodiment 1642

The compound of any of embodiments 1502 to 1627, wherein the compound comprises the nucleobase sequence of SEQ ID NO.: 34.

Embodiment 1643

The compound of any of embodiments 1502 to 1627, wherein the compound comprises the nucleobase sequence of any of SEQ ID NOs.: 35, 36, 37, 38, 39, 40, 41, 42, or 43.

Embodiment 1644

The compound of any of embodiments 1502 to 1627, wherein the compound comprises the nucleobase sequence of SEQ ID NO.: 44, 45, 46, 47, or 48.

Embodiment 1645

The compound of any of embodiments 1502 to 1627, wherein the compound comprises the nucleobase sequence of any of SEQ ID NOs.: 49, 50, 51, 52, 53, 54, 55, 56, 57, 58, or 59.

Embodiment 1646

The compound of any of embodiments 1502 to 1627, wherein the compound comprises the nucleobase sequence of any of SEQ ID NOs.: 60, 61, 62, 63, 64, 65, 66, or 67.

Embodiment 1647

The compound of any of embodiments 1502 to 1627, wherein the compound comprises the nucleobase sequence of any of SEQ ID NO.: 69, 70, 71, or 72.

Embodiment 1648

The compound of any of embodiments 1502 to 1627, wherein the compound comprises the nucleobase sequence of SEQ ID NO.: 73.

Embodiment 1649

The compound of any of embodiments 1502 to 1627, wherein the compound comprises the nucleobase sequence of any of SEQ ID NOs.: 74, 75, 76, 77, 78, 79, 80, or 81.

Embodiment 1650

The compound of any of embodiments 1502 to 1627, wherein the compound comprises the nucleobase sequence of SEQ ID NO.: 68.

Embodiment 1651

The compound of any of embodiments 1502 to 1627, wherein the compound comprises the nucleobase sequence of any of SEQ ID NOs.: 82-103, 111, or 113.

Embodiment 1652

The compound of any of embodiments 1502 to 1627, wherein the compound is an antisense oligonucleotide.

Embodiment 1653

A pharmaceutical composition comprising a compound or compound according to any of embodiments 1502 to 1652 and a pharmaceutically acceptable carrier or diluent.

Embodiment 1654

The pharmaceutical composition of embodiment 1653 wherein the pharmaceutically acceptable carrier or diluent is selected from among sterile water and sterile saline.

Embodiment 1655

A method of reducing the amount or activity of a target nucleic acid in a cell, comprising contacting a cell with a compound or conjugated antisense compound of any of embodiments 1498 to 1648, or the pharmaceutical composition of embodiments 1653 to 1654.

Embodiment 1656

The method of embodiment 1655, wherein the cell is a liver cell.

Embodiment 1657

The method of embodiment 1655, wherein the cell is a hepatocyte.

Embodiment 1658

The method of any of embodiments 1655 to 1657, wherein the cell is in vitro.

Embodiment 1659

The method of any of embodiments 1655 to 1657, wherein the cell is in an animal.

Embodiment 1660

The method of embodiment 1659 wherein the animal is a mouse.

Embodiment 1661

The method of embodiment 1659 wherein the animal is a human

Embodiment 1662

A method of treating a disease or condition in an animal comprising administering the pharmaceutical composition of embodiment 1653 or 1654 to the animal and thereby treating the disease or condition in the animal.

Embodiment 1663

The method of embodiment 1662 wherein the animal is a mouse.

Embodiment 1664

The method of embodiment 1662 wherein the animal is a human

Embodiment 1665

The method of any of embodiments 1662 to 1664, wherein the disease or condition is a liver disease or condition.

Embodiment 1666

The method of any of embodiments 1662 to 1665, wherein the administration is parenteral.

Embodiment 1667

The method of any of embodiments 1662 to 1665, wherein the administration is by subcutaneous injection.

Embodiment 1668

The method of any of embodiments 1662 to 1665, wherein the administration is by intravenous injection.

Embodiment 1669

The method of any of embodiments 1662 to 1665, wherein the administration is by intramuscular injection.

Embodiment 1670

The method of any of embodiments 1662 to 1669, wherein the compound is provided at a dose of 1-10 mg/kg.

Embodiment 1671

The method of any of embodiments 1662 to 1669, wherein the compound is provided at a dose of less than 1 mg/kg.

Embodiment 1672

The method of any of embodiments 1662 to 1669, wherein the compound is provided at a dose of greater than 10 mg/kg.

Embodiment 1673

The method of any of embodiments 1662 to 1669, wherein the compound is provided for a dosing period of at least 2 months.

Embodiment 1674

The method of any of embodiments 1662 to 1669, wherein the compound is provided for a dosing period of at least 4 months.

Embodiment 1675

The method of any of embodiments 1662 to 1669, wherein the compound is provided for a dosing period of at least 6 months.

Embodiment 1676

The method of any of embodiments 1662 to 1669, wherein the compound is provided at a dosing frequency of about one dose every week.

Embodiment 1677

The method of any of embodiments 1662 to 1669, wherein the compound is provided at a dosing frequency of about one dose every two weeks.

Embodiment 1678

The method of any of embodiments 1662 to 1669, wherein the compound is provided at a dosing frequency of about one dose every three weeks.

Embodiment 1679

The method of any of embodiments 1662 to 1669, wherein the compound is provided at a dosing frequency of one dose every four weeks.

Embodiment 1680

The method of any of embodiments 1662 to 1669, wherein the compound is provided at a dosing frequency of one dose every five weeks.

Embodiment 1681

The method of any of embodiments 1662 to 1669, wherein the compound is provided at a dosing frequency of one dose every six weeks.

Embodiment 1682

The method of any of embodiments 1662 to 1669, wherein the compound is provided at a dosing frequency of one dose every seven weeks.

Embodiment 1683

The method of any of embodiments 1662 to 1669, wherein the compound is provided at a dosing frequency of one dose every eight weeks.

Embodiment 1684

The compound or compound of any of embodiments 1 to 1652, or a prodrug thereof.

Embodiment 1685

A method of manufacturing an antisense oligonucleotide of any of embodiments 1 to 1652.

Embodiment 1686

A method of preparing an antisense oligonucleotide of any of embodiments 1 to 1652.

Embodiment 1687

A process for manufacturing a conjugated antisense compound of any one of embodiments 1 to 1652, wherein the method includes formulating the conjugated antisense compound for human use, performing chromatogram analysis of the formulated conjugated antisense compound, and packaging the conjugated antisense compound ready for sale.

Embodiment 1688

The conjugated antisense compound of any of embodiments 1179 to 1182, wherein the tether has a structure selected from among:

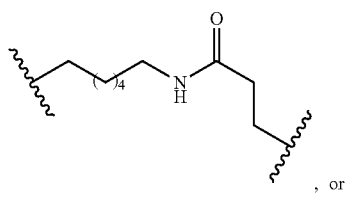

, or

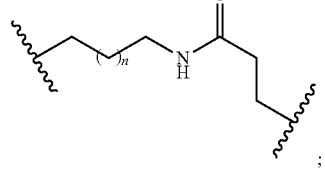

;

wherein each n is independently, 0, 1, 2, 3, 4, 5, 6, or 7.

Embodiment 1689

The conjugated antisense compound of any of embodiments 1179 to 1182, wherein the tether has the structure:

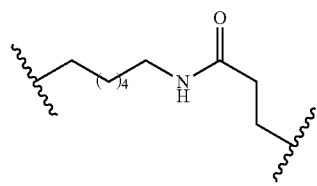

Embodiment 1690

The conjugated antisense compound of any of embodiments 1179 to 1182 or 1688 to 1689, wherein the linker has a structure selected from among:

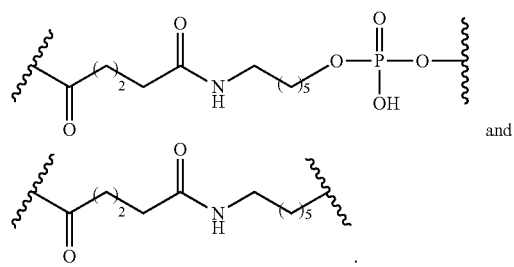

and

Embodiment 1691

The conjugated antisense compound of any of embodiments 1179 to 1182 or 1688 to 1689, wherein the linker has a structure selected from among:

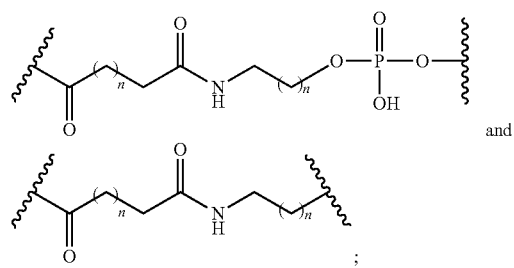

and

;

wherein each n is independently, 0, 1, 2, 3, 4, 5, 6, or 7.

Embodiment 1692

The conjugated antisense compound of any of embodiments 1179 to 1182 or 1688 to 1689, wherein the linker has the structure:

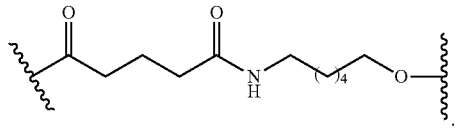

Embodiment 1693

A compound having the formula (XXVI):

(XXVI)

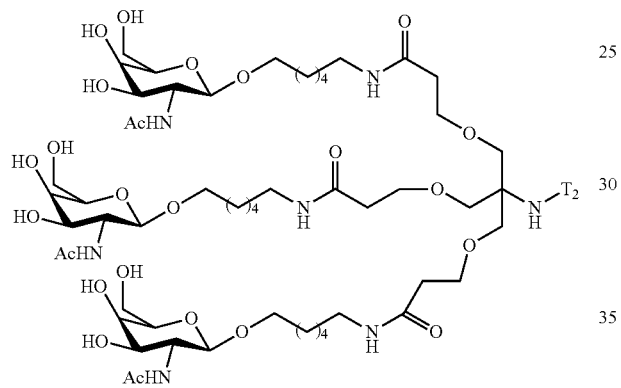

wherein:
T$_2$ is a group comprising a nucleoside, a nucleotide, a monomeric subunit, a reactive ester, a linker, a cleavable moiety or an oligomeric compound.

Embodiment 1694

The compound of embodiment 1693, wherein the linker comprises an amine, an amide, an ester, an ether, a pyrrolidine, PEG, a polyamide, or a disulfide bond.

Embodiment 1695

The compound of embodiment 1693 or 1694, wherein the linker does not comprise a pyrrolidine.

Embodiment 1696

The compound of any of embodiments 1693 to 1695, wherein the linker has the formula:

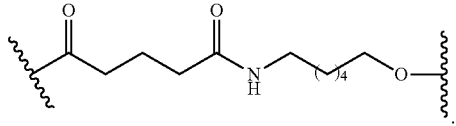

Embodiment 1697

The compound of any of embodiments 1693 to 1696, wherein T$_2$ has the formula:

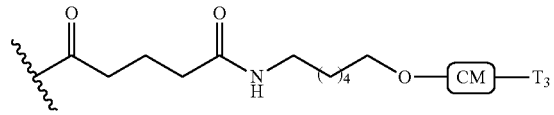

wherein:
CM is a cleavable moiety and T$_3$ is a nucleoside, a nucleotide, a monomeric subunit, or an oligomeric compound.

Embodiment 1698

The compound of any of embodiments 1693 to 1697, wherein T$_2$ has the formula:

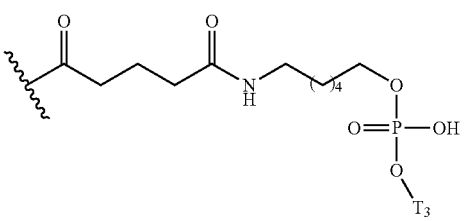

wherein:
T$_3$ is a nucleoside, a nucleotide, a monomeric subunit, or an oligomeric compound.

Embodiment 1699

The compound of any of embodiments 1693 to 1698, wherein T$_2$ or T$_3$ is a group comprising an oligomeric compound, and wherein the oligomeric compound is a modified oligonucleotide.

Embodiment 1700

The compound of embodiment 1699, wherein the modified oligonucleotide consists of 10 to 30 linked nucleosides wherein at least one nucleoside is a modified nucleoside.

Embodiment 1701

The compound of embodiment 1699 or 1700, wherein the modified oligonucleotide comprises at least one modified nucleoside selected from among: a 2'-MOE nucleoside, a 2'-OMe nucleoside, a 2'-F nucleoside, a (4'-CH$_2$—O-2') bicyclic nucleoside, a (4'-(CH$_2$)$_2$—O-2') bicyclic nucleoside, a (4'-C(CH$_3$)H—O-2') bicyclic nucleoside; and a morpholino.

Embodiment 1702

The compound of any of embodiments 1699 to 1701, wherein the modified oligonucleotide has a gapmer sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;

a 3'-region consisting of 2-8 linked 3'-region nucleosides, wherein at least two 3'-region nucleosides are modified nucleosides and wherein the 5'-most 3'-region nucleoside is a modified nucleoside; and a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 1703

The compound of embodiment 1702, wherein each 5'-region nucleoside is a modified nucleoside; each 3'-region nucleoside is a modified nucleoside; and each central region nucleoside is an unmodified deoxynucleoside.

Embodiment 1704

The compound of any of embodiments 1702 to 1704, wherein the 5'-region consists of 2-5 linked 5'-region nucleosides; the 3'-region consists of 2-5 linked 3'-region nucleosides; and the central region consists of 8-10 central region nucleosides.

Embodiment 1705

The compound of any of embodiments 1699 to 1704, wherein the modified oligonucleotide comprises at least one phosphorothioate internucleoside linkage.

Embodiment 1706

The compound of any of embodiments 1699 to 1705, wherein the modified oligonucleotide comprises at least one phosphodiester internucleoside linkage.

Embodiment 1707

The compound of any of embodiments 1699 to 1706, wherein each internucleoside linkage of the modified oligonucleotide is either phosphorothioate internucleoside linkage or a phosphodiester internucleoside linkage.

Embodiment 1708

The compound of any of embodiments 1699 to 1707, wherein the modified oligonucleotide is attached to the remainder of the compound at the 5'-end of the modified oligonucleotide.

Embodiment 1709

The compound of any of embodiments 1699 to 1707, wherein the modified oligonucleotide is attached to the remainder of the compound at the 3'-end of the modified oligonucleotide.

Embodiment 1710

The compound of any of embodiments 1699 to 1709, wherein the modified oligonucleotide is an antisense oligonucleotide.

Embodiment 1711

The compound of embodiment any of embodiments 1699 to 1710, wherein the modified oligonucleotide is single-stranded.

Embodiment 1712

The compound of any of embodiments 1699 to 1710, wherein the modified oligonucleotide is double-stranded.

Embodiment 1713

The compound of any of embodiments 1699 to 1712, wherein the modified oligonucleotide activates the RISC pathway.

Embodiment 1714

The compound of any of embodiments 1699 to 1712, wherein the modified oligonucleotide is an RNase H based antisense compound.

Embodiment 1715

The compound of any of embodiments 1699 to 1712, wherein the modified oligonucleotide alters splicing of a target pre-mRNA.

Embodiment 1716

The compound of any of embodiments 1699 to 1715, wherein the modified oligonucleotide is complementary to a target nucleic acid.

Embodiment 1717

The compound of embodiment 1716, wherein the target nucleic acid is selected from among: pre-mRNA, microRNA, or long non-coding RNA.

Embodiment 1718

The compound of any of embodiments 1699 to 1717, wherein the modified oligonucleotide consists of 12 to 30 linked nucleosides.

Embodiment 1719

The compound of any of embodiments 1699 to 1717, wherein the modified oligonucleotide consists of 18 to 22 linked nucleosides.

Embodiment 1720

The compound of any of embodiments 1699 to 1717, wherein the modified oligonucleotide consists of 16 to 20 linked nucleosides.

475

Embodiment 1721

A method of administering the compound of any of embodiments 1693 to 1720 to an animal.

Embodiment 1722

A method of treating a metabolic disorder comprising administering the compound of any of embodiments 1693 to 1720 to a subject in need thereof.

Embodiment 1723

A method of treating a cardiovascular disorder comprising administering the compound of any of embodiments 1693 to 1720 to a subject in need thereof.

Embodiment 1724

A compound having the formula (XXXI):

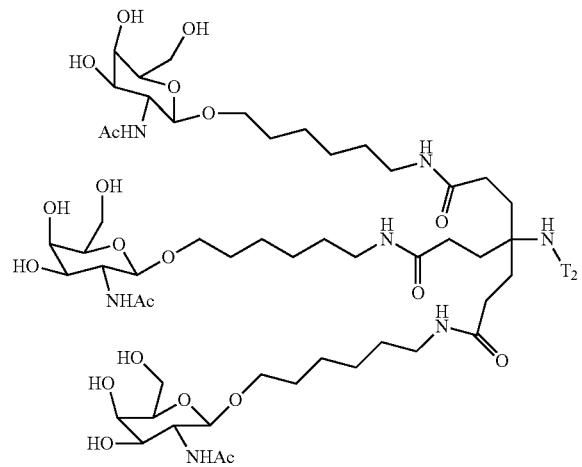

(XXXI)

wherein:
$T_2$ is a group comprising a nucleoside, a nucleotide, a monomeric subunit, a reactive ester, a linker, a cleavable moiety or an oligomeric compound.

Embodiment 1725

The compound of embodiment 1724, wherein the linker comprises an amine, an amide, an ester, an ether, a pyrrolidine, PEG, a polyamide, or a disulfide bond.

Embodiment 1726

The compound of embodiment 1724 or 1725, wherein the linker does not comprise a pyrrolidine.

Embodiment 1727

The compound of any of embodiments 1724 to 1726, wherein the linker is:

476

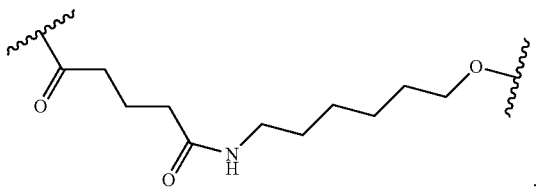 [SMILES: *OCCCCCCNC(=O)CCCC(*)=O]

Embodiment 1728

The compound of any of embodiments 1724 to 1727, wherein $T_2$ has the formula:

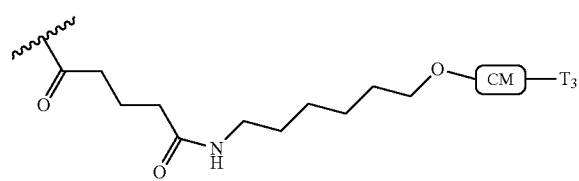

wherein:
CM represents a cleavable moiety and $T_3$ is a nucleoside, a nucleotide, a monomeric subunit, or an oligomeric compound.

Embodiment 1729

The compound of any of embodiments 1724 to 1728, wherein $T_2$ has the formula:

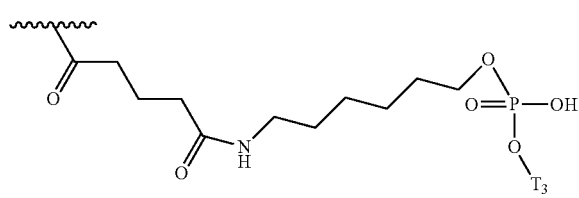

wherein:
$T_3$ is a nucleoside, a nucleotide, a monomeric subunit, or an oligomeric compound.

Embodiment 1730

The compound of any of embodiments 1724 to 1729, wherein $T_2$ or $T_3$ is a group comprising an oligomeric compound, and wherein the oligomeric compound is a modified oligonucleotide.

Embodiment 1731

The compound of embodiment 1730, wherein the modified oligonucleotide consists of 10 to 30 linked nucleosides wherein at least one nucleoside is a modified nucleoside.

Embodiment 1732

The compound of embodiment 1730 or 1731, wherein the modified oligonucleotide comprises at least one modified nucleoside selected from among: a 2'-MOE nucleoside, a 2'-OMe nucleoside, a 2'-F nucleoside, a (4'-$CH_2$—O-2') bicyclic nucleoside, a (4'-$(CH_2)_2$—O-2')

bicyclic nucleoside, a (4'-C(CH$_3$)H—O-2') bicyclic nucleoside; and a morpholino.

Embodiment 1733

The compound of any of embodiments 1730 to 1732, wherein the modified oligonucleotide has a gapmer sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 1734

The compound of embodiment 1733, wherein each 5'-region nucleoside is a modified nucleoside; each 3'-region nucleoside is a modified nucleoside; and each central region nucleoside is an unmodified deoxynucleoside.

Embodiment 1735

The compound of any of embodiments 1733 to 1734, wherein the 5'-region consists of 2-5 linked 5'-region nucleosides; the 3'-region consists of 2-5 linked 3'-region nucleosides; and the central region consists of 8-10 central region nucleosides.

Embodiment 1736

The compound of any of embodiments 1730 to 1735, wherein the modified oligonucleotide comprises at least one phosphorothioate internucleoside linkage.

Embodiment 1737

The compound of any of embodiments 1730 to 1736, wherein the modified oligonucleotide comprises at least one phosphodiester internucleoside linkage.

Embodiment 1738

The compound of any of embodiments 1730 to 1737, wherein each internucleoside linkage of the modified oligonucleotide is either phosphorothioate internucleoside linkage or a phosphodiester internucleoside linkage.

Embodiment 1739

The compound of any of embodiments 1730 to 1738, wherein the modified oligonucleotide is attached to the remainder of the compound at the 5'-end of the modified oligonucleotide.

Embodiment 1740

The compound of any of embodiments 1730 to 1738, wherein the modified oligonucleotide is attached to the remainder of the compound at the 3'-end of the modified oligonucleotide.

Embodiment 1741

The compound of any of embodiments 1730 to 1740, wherein the modified oligonucleotide is an antisense oligonucleotide.

Embodiment 1742

The compound of embodiment any of embodiments 1730 to 1741, wherein the modified oligonucleotide is single-stranded.

Embodiment 1743

The compound of any of embodiments 1730 to 1741, wherein the modified oligonucleotide is double-stranded.

Embodiment 1744

The compound of any of embodiments 1730 to 1743, wherein the modified oligonucleotide activates the RISC pathway.

Embodiment 1745

The compound of any of embodiments 1730 to 1743, wherein the modified oligonucleotide is an RNase H based antisense compound.

Embodiment 1746

The compound of any of embodiments 1730 to 1743, wherein the modified oligonucleotide alters splicing of a target pre-mRNA.

Embodiment 1747

The compound of any of embodiments 1730 to 1746, wherein the modified oligonucleotide is complementary to a target nucleic acid.

Embodiment 1748

The compound of embodiment 1747, wherein the target nucleic acid is selected from among: pre-mRNA, microRNA, or long non-coding RNA.

Embodiment 1749

The compound of any of embodiments 1730 to 1748, wherein the modified oligonucleotide consists of 12 to 30 linked nucleosides.

Embodiment 1750

The compound of any of embodiments 1730 to 1748, wherein the modified oligonucleotide consists of 18 to 22 linked nucleosides.

Embodiment 1751

The compound of any of embodiments 1730 to 1748, wherein the modified oligonucleotide consists of 16 to 20 linked nucleosides.

Embodiment 1752

A method of administering the compound of any of embodiments 1724 to 1751 to an animal.

Embodiment 1753

A method of treating a metabolic disorder comprising administering the compound of any of embodiments 1724 to 1751 to a subject in need thereof.

Embodiment 1754

A method of treating a cardiovascular disorder comprising administering the compound of any of embodiments 1724 to 1751 to a subject in need thereof.

Embodiment 1755

A compound having the formula (XXXII):

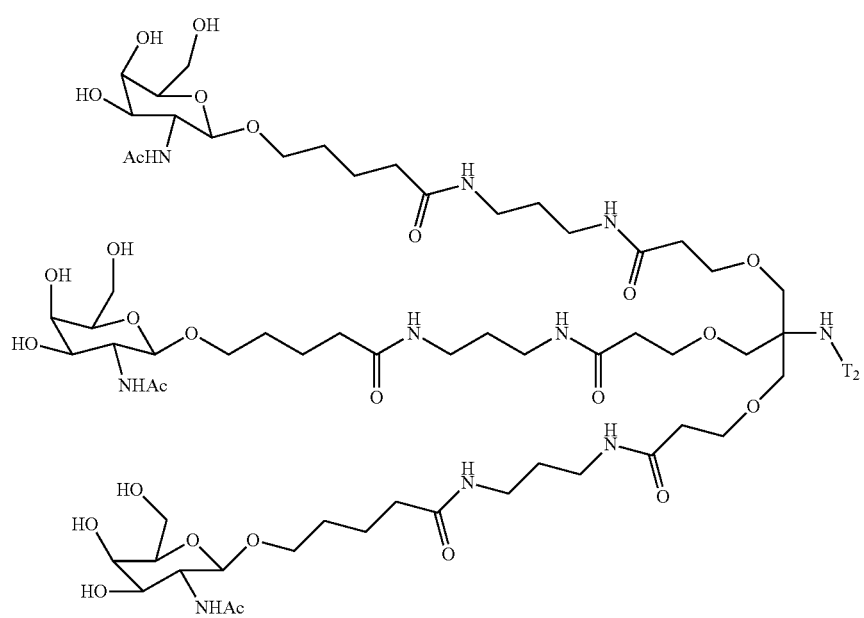

(XXXII)

wherein:
$T_2$ is a group comprising a nucleoside, a nucleotide, a monomeric subunit, a reactive ester, a linker, a cleavable moiety or an oligomeric compound.

Embodiment 1756

The compound of embodiment 1755, wherein the linker comprises an amine, an amide, an ester, an ether, a pyrrolidine, PEG, a polyamide, or a disulfide bond.

Embodiment 1757

The compound of embodiment 1755 or 1756, wherein the linker does not comprise a pyrrolidine.

Embodiment 1758

The compound of any of embodiments 1755 to 1757, wherein the linker is:

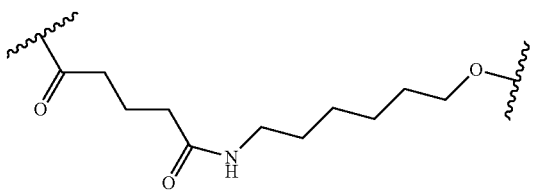

Embodiment 1759

The compound of any of embodiments 1755 to 1758, wherein $T_2$ has the formula:

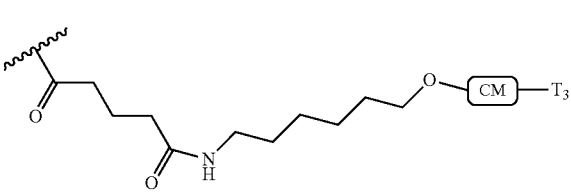

wherein:
CM is a cleavable moiety and $T_3$ is a nucleoside, a nucleotide, a monomeric subunit, or an oligomeric compound.

Embodiment 1760

The compound of any of embodiments 1755 to 1759, wherein $T_2$ has the formula:

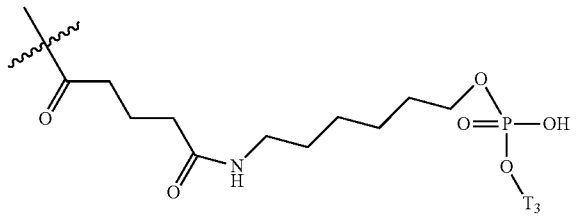

wherein:
$T_3$ is a nucleoside, a nucleotide, a monomeric subunit, or an oligomeric compound.

Embodiment 1761

The compound of any of embodiments 1755 to 1760, wherein $T_2$ or $T_3$ is a group comprising an oligomeric compound, and wherein the oligomeric compound is a modified oligonucleotide.

Embodiment 1762

The compound of embodiment 1761, wherein the modified oligonucleotide consists of 10 to 30 linked nucleosides wherein at least one nucleoside is a modified nucleoside.

Embodiment 1763

The compound of embodiment 1761 or 1762, wherein the modified oligonucleotide comprises at least one modified nucleoside selected from among: a 2'-MOE nucleoside, a 2'-OMe nucleoside, a 2'-F nucleoside, a (4'-CH$_2$—O-2') bicyclic nucleoside, a (4'-(CH$_2$)$_2$—O-2') bicyclic nucleoside, a (4'-C(CH$_3$)H—O-2') bicyclic nucleoside; and a morpholino.

Embodiment 1764

The compound of any of embodiments 1761 to 1763, wherein the modified oligonucleotide has a gapmer sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 1765

The compound of embodiment 1764, wherein each 5'-region nucleoside is a modified nucleoside; each 3'-region nucleoside is a modified nucleoside; and each central region nucleoside is an unmodified deoxynucleoside.

Embodiment 1766

The compound of any of embodiments 1764 to 1765, wherein the 5'-region consists of 2-5 linked 5'-region nucleosides; the 3'-region consists of 2-5 linked 3'-region nucleosides; and the central region consists of 8-10 central region nucleosides.

Embodiment 1767

The compound of any of embodiments 1761 to 1766, wherein the modified oligonucleotide comprises at least one phosphorothioate internucleoside linkage.

Embodiment 1768

The compound of any of embodiments 1761 to 1767, wherein the modified oligonucleotide comprises at least one phosphodiester internucleoside linkage.

Embodiment 1769

The compound of any of embodiments 1761 to 1768, wherein each internucleoside linkage of the modified oligonucleotide is either phosphorothioate internucleoside linkage or a phosphodiester internucleoside linkage.

Embodiment 1770

The compound of any of embodiments 1761 to 1769, wherein the modified oligonucleotide is attached to the remainder of the compound at the 5'-end of the modified oligonucleotide.

Embodiment 1771

The compound of any of embodiments 1761 to 1769, wherein the modified oligonucleotide is attached to the remainder of the compound at the 3'-end of the modified oligonucleotide.

Embodiment 1772

The compound of any of embodiments 1761 to 1771, wherein the modified oligonucleotide is an antisense oligonucleotide.

Embodiment 1773

The compound of embodiment any of embodiments 1761 to 1772, wherein the modified oligonucleotide is single-stranded.

Embodiment 1774

The compound of any of embodiments 1761 to 1772, wherein the modified oligonucleotide is double-stranded.

Embodiment 1775

The compound of any of embodiments 1761 to 1774, wherein the modified oligonucleotide activates the RISC pathway.

Embodiment 1776

The compound of any of embodiments 1761 to 1774, wherein the modified oligonucleotide is an RNase H based antisense compound.

Embodiment 1777

The compound of any of embodiments 1761 to 1774, wherein the modified oligonucleotide alters splicing of a target pre-mRNA.

Embodiment 1778

The compound of any of embodiments 1761 to 1777, wherein the modified oligonucleotide is complementary to a target nucleic acid.

Embodiment 1779

The compound of embodiment 1779, wherein the target nucleic acid is selected from among: pre-mRNA, microRNA, or long non-coding RNA.

Embodiment 1780

The compound of any of embodiments 1761 to 1779, wherein the modified oligonucleotide consists of 12 to 30 linked nucleosides.

Embodiment 1781

The compound of any of embodiments 1761 to 1779, wherein the modified oligonucleotide consists of 18 to 22 linked nucleosides.

Embodiment 1782

The compound of any of embodiments 1761 to 1779, wherein the modified oligonucleotide consists of 16 to 20 linked nucleosides.

Embodiment 1783

A method of administering the compound of any of embodiments 1755 to 1782 to an animal.

Embodiment 1784

A method of treating a metabolic disorder comprising administering the compound of any of embodiments 1755 to 1782 to a subject in need thereof.

Embodiment 1785

A method of treating a cardiovascular disorder comprising administering the compound of any of embodiments 1755 to 1782 to a subject in need thereof.

Embodiment 1786

A compound having the formula (XXXVIII):

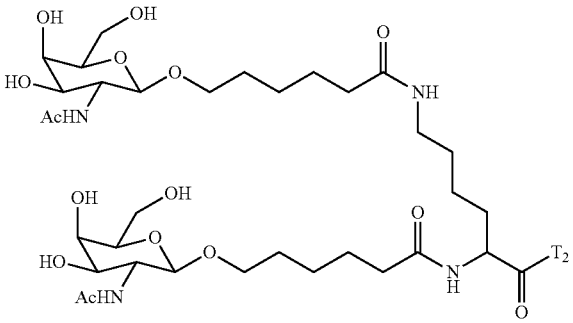

(XXXVIII)

wherein:
$T_2$ is a group comprising a nucleoside, a nucleotide, a monomeric subunit, a reactive ester, a linker, a cleavable moiety or an oligomeric compound.

Embodiment 1787

The compound of embodiment 1786, wherein the linker comprises an amine, an amide, an ester, an ether, a pyrrolidine, PEG, a polyamide, or a disulfide bond.

Embodiment 1788

The compound of embodiment 1786 or 1787, wherein the linker does not comprise a pyrrolidine.

Embodiment 1789

The compound of any of embodiments 1786 to 1788, wherein the linker is:

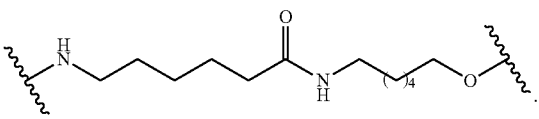

Embodiment 1790

The compound of any of embodiments 1786 to 1789, wherein $T_2$ has the formula:

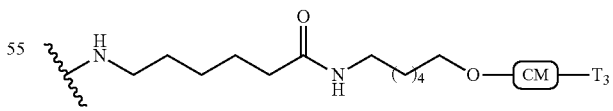

wherein:
CM is a cleavable moiety and $T_3$ is a nucleoside, a nucleotide, a monomeric subunit, or an oligomeric compound.

Embodiment 1791

The compound of any of embodiments 1786 to 1790, wherein $T_2$ has the formula:

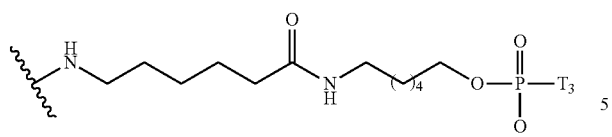

wherein:
T$_3$ is a nucleoside, a nucleotide, a monomeric subunit, or an oligomeric compound.

Embodiment 1792

The compound of any of embodiments 1786 to 1791, wherein T$_2$ or T$_3$ is a group comprising an oligomeric compound, and wherein the oligomeric compound is a modified oligonucleotide.

Embodiment 1793

The compound of embodiment 1792, wherein the modified oligonucleotide consists of 10 to 30 linked nucleosides wherein at least one nucleoside is a modified nucleoside.

Embodiment 1794

The compound of embodiment 1792 or 1793, wherein the modified oligonucleotide comprises at least one modified nucleoside selected from among: a 2'-MOE nucleoside, a 2'-OMe nucleoside, a 2'-F nucleoside, a (4'-CH$_2$—O-2') bicyclic nucleoside, a (4'-(CH$_2$)$_2$—O-2') bicyclic nucleoside, a (4'-C(CH$_3$)H—O-2') bicyclic nucleoside; and a morpholino.

Embodiment 1795

The compound of any of embodiments 1792 to 1794, wherein the modified oligonucleotide has a gapmer sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 1796

The compound of embodiment 1795, wherein each 5'-region nucleoside is a modified nucleoside; each 3'-region nucleoside is a modified nucleoside; and each central region nucleoside is an unmodified deoxynucleoside.

Embodiment 1797

The compound of any of embodiments 1795 to 1796, wherein the 5'-region consists of 2-5 linked 5'-region nucleosides; the 3'-region consists of 2-5 linked 3'-region nucleosides; and the central region consists of 8-10 central region nucleosides.

Embodiment 1798

The compound of any of embodiments 1792 to 1797, wherein the modified oligonucleotide comprises at least one phosphorothioate internucleoside linkage.

Embodiment 1799

The compound of any of embodiments 1792 to 1798, wherein the modified oligonucleotide comprises at least one phosphodiester internucleoside linkage.

Embodiment 1800

The compound of any of embodiments 1792 to 1799, wherein each internucleoside linkage of the modified oligonucleotide is either phosphorothioate internucleoside linkage or a phosphodiester internucleoside linkage.

Embodiment 1801

The compound of any of embodiments 1792 to 1800, wherein the modified oligonucleotide is attached to the remainder of the compound at the 5'-end of the modified oligonucleotide.

Embodiment 1802

The compound of any of embodiments 1792 to 1800, wherein the modified oligonucleotide is attached to the remainder of the compound at the 3'-end of the modified oligonucleotide.

Embodiment 1803

The compound of any of embodiments 1792 to 1802, wherein the modified oligonucleotide is an antisense compound.

Embodiment 1804

The compound of embodiment any of embodiments 1792 to 1803, wherein the modified oligonucleotide is single-stranded.

Embodiment 1805

The compound of any of embodiments 1792 to 1803, wherein the modified oligonucleotide is double-stranded.

Embodiment 1806

The compound of any of embodiments 1792 to 1805, wherein the modified oligonucleotide activates the RISC pathway.

Embodiment 1807

The compound of any of embodiments 1792 to 1805, wherein the modified oligonucleotide is an RNase H based antisense compound.

Embodiment 1808

The compound of any of embodiments 1792 to 1805, wherein the modified oligonucleotide alters splicing of a target pre-mRNA.

Embodiment 1809

The compound of any of embodiments 1792 to 1808, wherein the modified oligonucleotide is complementary to a target nucleic acid.

Embodiment 1810

The compound of embodiment 1809, wherein the target nucleic acid is selected from among: pre-mRNA, micro-RNA, or long non-coding RNA.

Embodiment 1811

The compound of any of embodiments 1792 to 1810, wherein the modified oligonucleotide consists of 12 to 30 linked nucleosides.

Embodiment 1812

The compound of any of embodiments 1792 to 1810, wherein the modified oligonucleotide consists of 18 to 22 linked nucleosides.

Embodiment 1813

The compound of any of embodiments 1792 to 1810, wherein the modified oligonucleotide consists of 16 to 20 linked nucleosides.

Embodiment 1814

A method of administering the compound of any of embodiments 1786 to 1813 to an animal.

Embodiment 1815

A method of treating a metabolic disorder comprising administering the compound of any of embodiments 1786 to 1813 to a subject in need thereof.

Embodiment 1816

A method of treating a cardiovascular disorder comprising administering the compound of any of embodiments 1786 to 1813 to a subject in need thereof.

Embodiment 1817

A compound having the formula (XL):

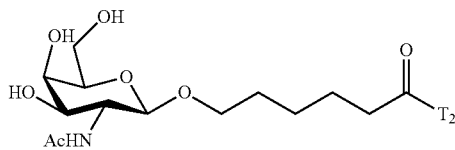

(XL)

wherein:

$T_2$ is a group comprising a nucleoside, a nucleotide, a monomeric subunit, a reactive ester, a linker, a cleavable moiety or an oligomeric compound.

Embodiment 1818

The compound of embodiment 1817, wherein the linker comprises an amine, an amide, an ester, an ether, a pyrrolidine, PEG, a polyamide, or a disulfide bond.

Embodiment 1819

The compound of embodiment 1817 or 1818, wherein the linker does not comprise a pyrrolidine.

Embodiment 1820

The compound of any of embodiments 1817 to 1819, wherein the linker is:

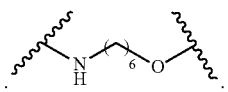

Embodiment 1821

The compound of any of embodiments 1817 to 1820, wherein $T_2$ has the formula:

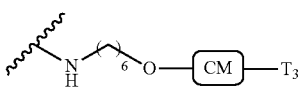

wherein:

CM is a cleavable moiety and $T_3$ is a nucleoside, a nucleotide, a monomeric subunit, or an oligomeric compound.

Embodiment 1822

The compound of any of embodiments 1817 to 1821, wherein $T_2$ has the formula:

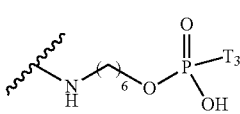

wherein:

$T_3$ is a nucleoside, a nucleotide, a monomeric subunit, or an oligomeric compound.

Embodiment 1823

The compound of any of embodiments 1817 to 1822, wherein $T_2$ or $T_3$ is a group comprising an oligomeric compound, and wherein the oligomeric compound is a modified oligonucleotide.

Embodiment 1824

The compound of embodiment 1823, wherein the modified oligonucleotide consists of 10 to 30 linked nucleosides wherein at least one nucleoside is a modified nucleoside.

Embodiment 1825

The compound of embodiment 1824, wherein the modified oligonucleotide comprises at least one modified nucleoside selected from among: a 2'-MOE nucleoside, a 2'-OMe nucleoside, a 2'-F nucleoside, a (4'-$CH_2$—O-2') bicyclic nucleoside, a (4'-$(CH_2)_2$—O-2') bicyclic nucleoside, a (4'-$C(CH_3)H$—O-2') bicyclic nucleoside; and a morpholino.

Embodiment 1826

The compound of any of embodiments 1824 to 1825, wherein the modified oligonucleotide has a gapmer sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 1827

The compound of embodiment 1826, wherein each 5'-region nucleoside is a modified nucleoside; each 3'-region nucleoside is a modified nucleoside; and each central region nucleoside is an unmodified deoxynucleoside.

Embodiment 1828

The compound of any of embodiments 1825 to 1826, wherein the 5'-region consists of 2-5 linked 5'-region nucleosides; the 3'-region consists of 2-5 linked 3'-region nucleosides; and the central region consists of 8-10 central region nucleosides.

Embodiment 1829

The compound of any of embodiments 1824 to 1828 wherein the modified oligonucleotide comprises at least one phosphorothioate internucleoside linkage.

Embodiment 1830

The compound of any of embodiments 1824 to 1829, wherein the modified oligonucleotide comprises at least one phosphodiester internucleoside linkage.

Embodiment 1831

The compound of any of embodiments 1824 to 1830, wherein each internucleoside linkage of the modified oligonucleotide is either phosphorothioate internucleoside linkage or a phosphodiester internucleoside linkage.

Embodiment 1832

The compound of any of embodiments 1824 to 1831, wherein the modified oligonucleotide is attached to the remainder of the compound at the 5'-end of the modified oligonucleotide.

Embodiment 1833

The compound of any of embodiments 1824 to 1831, wherein the modified oligonucleotide is attached to the remainder of the compound at the 3'-end of the modified oligonucleotide.

Embodiment 1834

The compound of any of embodiments 1824 to 1833, wherein the modified oligonucleotide is an antisense oligonucleotide.

Embodiment 1835

The compound of embodiment any of embodiments 1824 to 1834, wherein the modified oligonucleotide is single-stranded.

Embodiment 1836

The compound of any of embodiments 1824 to 1834, wherein the modified oligonucleotide is double-stranded.

Embodiment 1837

The compound of any of embodiments 1824 to 1836, wherein the modified oligonucleotide activates the RISC pathway.

Embodiment 1838

The compound of any of embodiments 1824 to 1836, wherein the modified oligonucleotide is an RNase H based antisense compound.

Embodiment 1839

The compound of any of embodiments 1824 to 1836, wherein the modified oligonucleotide alters splicing of a target pre-mRNA.

Embodiment 1840

The compound of any of embodiments 1824 to 1839, wherein the modified oligonucleotide is complementary to a target nucleic acid.

Embodiment 1841

The compound of embodiment 1840, wherein the target nucleic acid is selected from among: pre-mRNA, micro-RNA, or long non-coding RNA.

Embodiment 1842

The compound of any of embodiments 1824 to 1841, wherein the modified oligonucleotide consists of 12 to 30 linked nucleosides.

Embodiment 1843

The compound of any of embodiments 1824 to 1841, wherein the modified oligonucleotide consists of 18 to 22 linked nucleosides.

Embodiment 1844

The compound of any of embodiments 1824 to 1841, wherein the modified oligonucleotide consists of 16 to 20 linked nucleosides.

Embodiment 1845

A method of administering the compound of any of embodiments 1817 to 1844 to an animal.

Embodiment 1846

A method of treating a metabolic disorder comprising administering the compound of any of embodiments 1817 to 1844 to a subject in need thereof.

Embodiment 1847

A method of treating a cardiovascular disorder comprising administering the compound of any of embodiments 1817 to 1844 to a subject in need thereof.

Embodiment 1848

A method comprising administering a conjugated antisense compound to an animal, wherein the conjugated antisense compound comprises a modified oligonucleotide having a gapmer sugar motif and a conjugate comprising a GalNAc.

Embodiment 1849

A method of reducing the amount or activity of a target nucleic acid in a cell in an animal comprising administering to the animal a conjugated antisense compound comprising a modified oligonucleotide and a conjugate, wherein the modified oligonucleotide has a gapmer sugar motif and the conjugate comprises a GalNAc; and thereby reducing the amount or activity of the target nucleic acid in the cell in the animal.

Embodiment 1850

The method of embodiment 1848 or 1849, wherein the conjugate comprises the following structure:

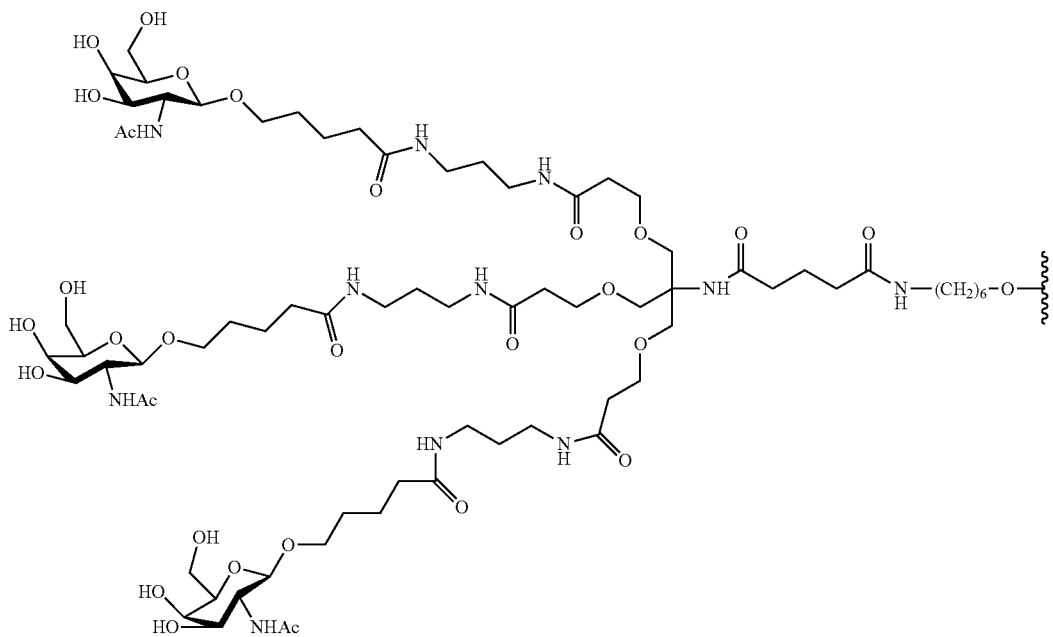

Embodiment 1851
The method of embodiment 1848 or 1849, wherein the conjugate comprises the following structure:
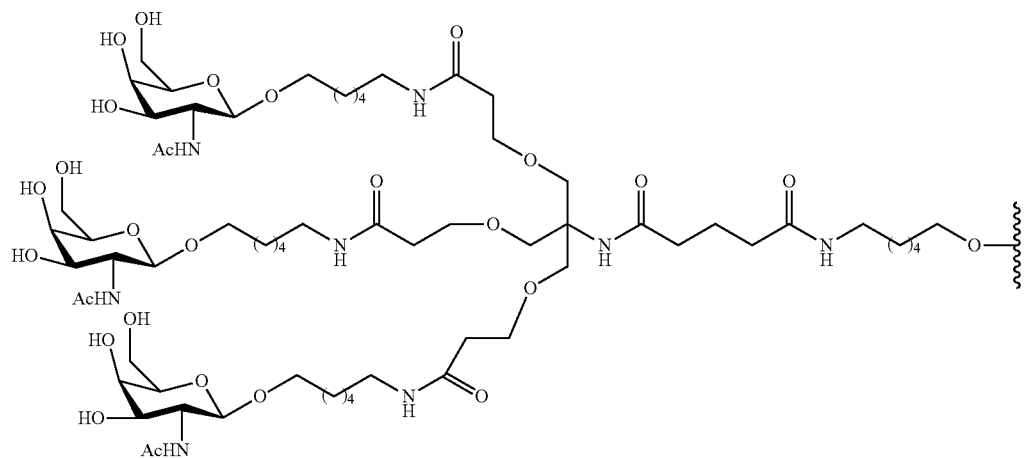
Embodiment 1852
The method of embodiment 1848 or 1849, wherein the conjugate comprises the following structure:
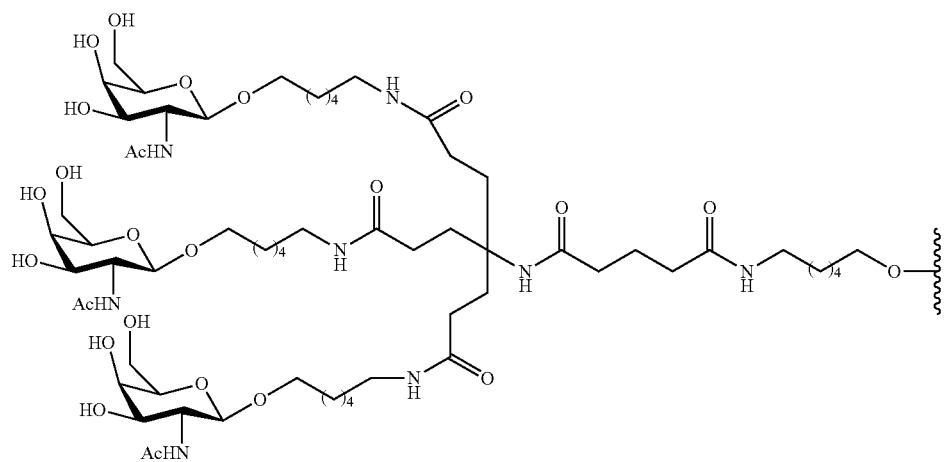

Embodiment 1853
The method of embodiment 1848 or 1849, wherein the conjugate comprises the following structure:
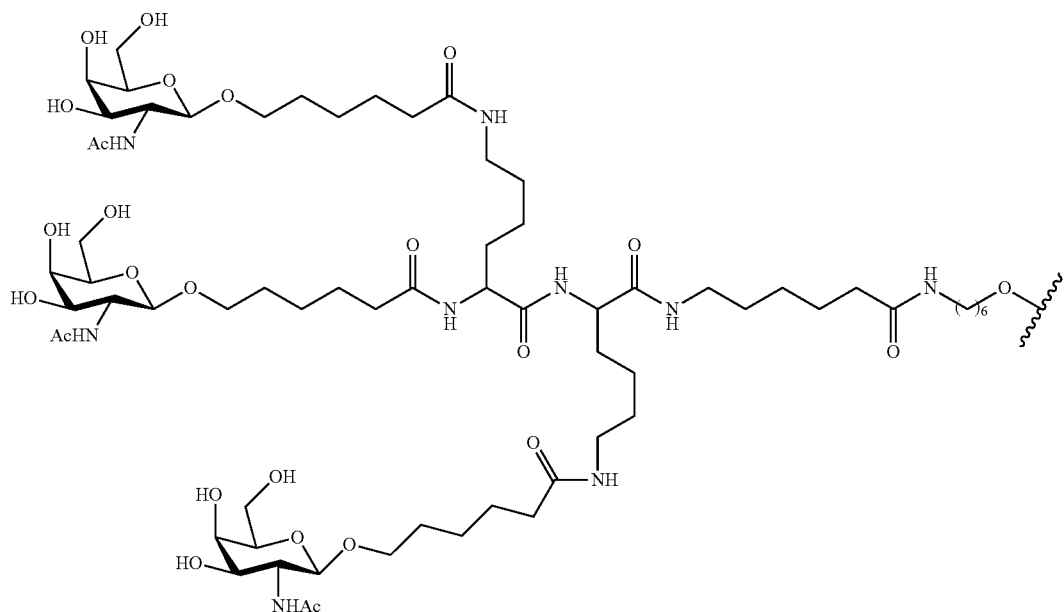
Embodiment 1854
The method of embodiment 1848 or 1849, wherein the conjugate comprises the following structure:
Embodiment 1855
The method of embodiment 1848 or 1849, wherein the conjugate comprises the following structure:
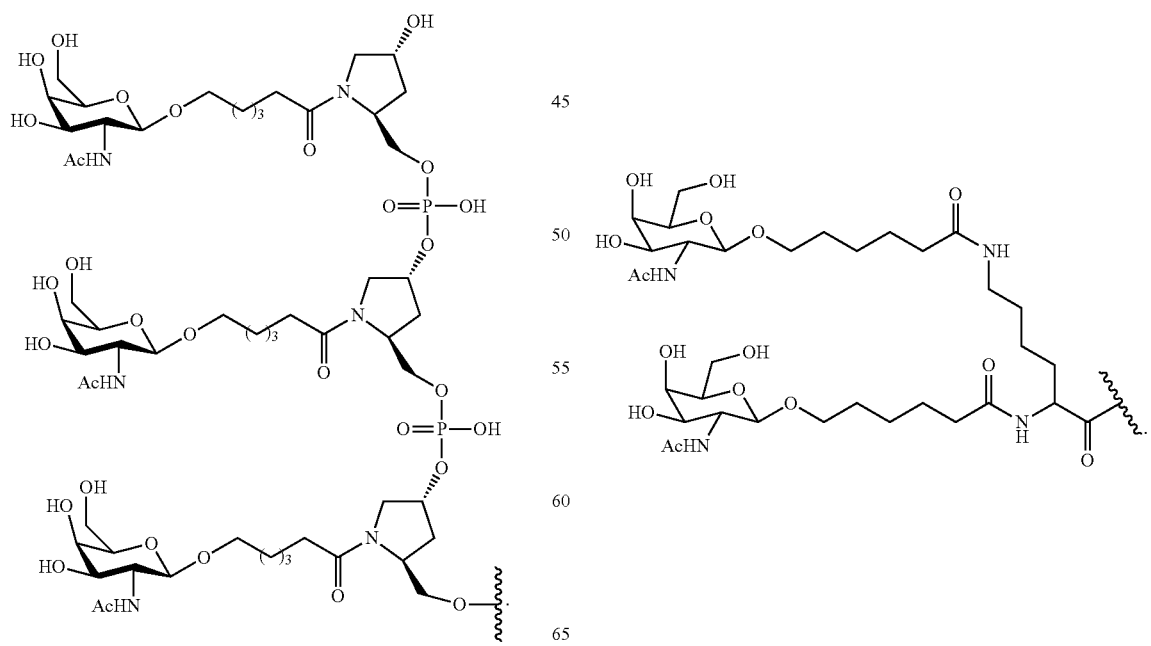

Embodiment 1856

The method of embodiment 1848 or 1849, wherein the conjugate comprises the following structure:

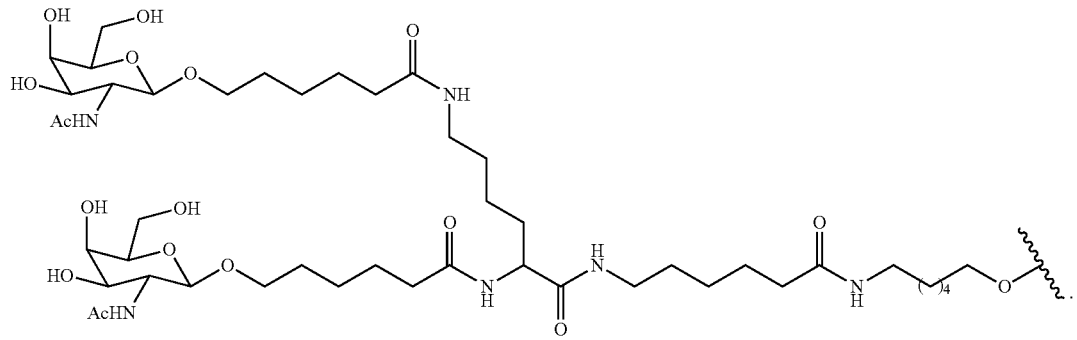

Embodiment 1857

The method of embodiment 1848 or 1849, wherein the conjugate comprises the following structure:

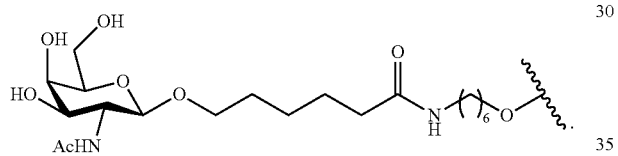

Embodiment 1858

The method of embodiment 1848 or 1849, wherein the conjugate has a branching group selected from the following structures:

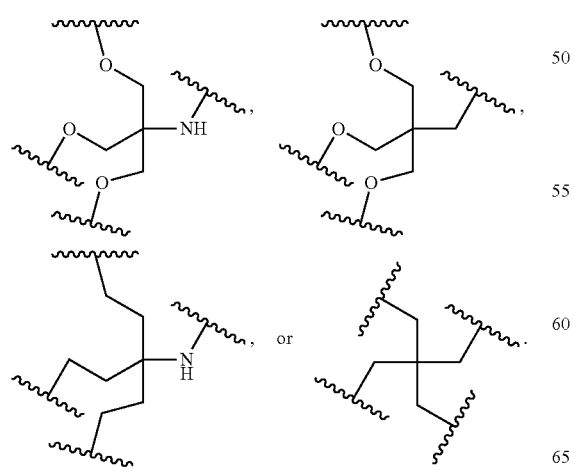

Embodiment 1859

The method of embodiment 1848 or 1849, wherein the conjugate has a linker selected from the following structures:

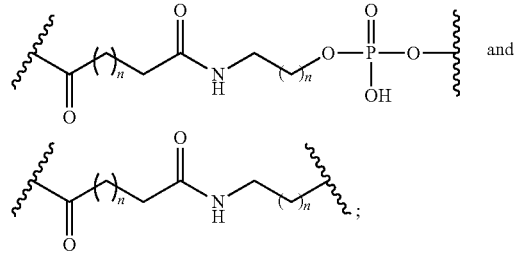

wherein each n is independently selected from 0, 1, 2, 3, 4, 5, 6, or 7.

Embodiment 1860

The method of any of embodiments 1848 to 1859, wherein the modified oligonucleotide comprises at least one modified internucleoside linkage.

Embodiment 1861

The method of embodiment 1860, wherein the modified internucleoside linkage is a phosphorothioate internucleoside linkage.

Embodiment 1862

The method of embodiment 1860 or 1861, wherein the modified oligonucleotide comprises at least one phosphodiester internucleoside linkage.

Embodiment 1863

The method of embodiment 1860 or 1861, wherein the modified oligonucleotide comprises at least 2 phosphodiester internucleoside linkages.

Embodiment 1864

The method of embodiment 1860 or 1861, wherein the modified oligonucleotide comprises at least 3 phosphodiester internucleoside linkages.

Embodiment 1865

The method of embodiment 1860 or 1861, wherein the modified oligonucleotide comprises at least 4 phosphodiester internucleoside linkages.

Embodiment 1866

The method of embodiment 1860 or 1861, wherein the modified oligonucleotide comprises at least 5 phosphodiester internucleoside linkages.

Embodiment 1867

The method of embodiment 1860 or 1861, wherein the modified oligonucleotide comprises at least 6 phosphodiester internucleoside linkages.

Embodiment 1868

The method of embodiment 1860 or 1861, wherein the modified oligonucleotide comprises at least 7 phosphodiester internucleoside linkages.

Embodiment 1869

The method of any of embodiments 1848 to 1868, wherein each internucleoside linkage of the modified oligonucleotide is selected from a phosphodiester internucleoside linkage and a phosphorothioate internucleoside linkage.

Embodiment 1870

The method of embodiment 1869, wherein each internucleoside linkage of the modified oligonucleotide is a phosphorothioate internucleoside linkage.

Embodiment 1871

The method of any of embodiments 1848 to 1870, wherein modified oligonucleotide is at least 80% complementary to a target nucleic acid.

Embodiment 1872

The method of any of embodiments 1848 to 1870, wherein modified oligonucleotide is at least 85% complementary to a target nucleic acid.

Embodiment 1873

The method of any of embodiments 1848 to 1870, wherein modified oligonucleotide is at least 90% complementary to a target nucleic acid.

Embodiment 1874

The method of any of embodiments 1848 to 1870, wherein modified oligonucleotide is 100% complementary to a target nucleic acid.

Embodiment 1875

The method of any of embodiments 1848 to 1874, wherein the target nucleic acid is expressed in the liver.

Embodiment 1876

The method of any of embodiments 1848 to 1875, wherein the target nucleic acid is expressed in hepatocytes.

Embodiment 1877

The method of any of embodiments 1848 to 1876, wherein the target nucleic encodes a protein selected from among: Androgen Receptor, Apolipoprotein (a), Apolipoprotein B, Apolipoprotein C-III, C-Reactive Protein, eIF-4E, Factor VII, Factor XI, Glucocorticoid Receptor, Glucagon Receptor, Protein Tyrosine Phosphatase 1B, STAT3, and Transthyretin.

Embodiment 1878

A method of modulating splicing of a pre-mRNA target nucleic acid in a cell comprising contacting the cell with a conjugated antisense compound, wherein the conjugated antisense compound comprises a modified oligonucleotide and a conjugate; and wherein the conjugate comprises a GalNac; and thereby modulating splicing of the pre-mRNA target nucleic acid in the cell.

Embodiment 1879

The method of embodiment 1878, wherein the pre-mRNA target nucleic acid is expressed in a hepatocyte.

Embodiment 1880

The method of embodiment 1878 or 1879, wherein the cell is in vitro.

Embodiment 1881

The method of embodiment 1878 or 1879, wherein the cell is in vivo.

Embodiment 1882

The method of embodiment 1878 or 1879, wherein the cell is in an animal.

Embodiment 1883

The method of any of embodiments 1878 to 1882, wherein the modified oligonucleotide comprises at least one modified nucleoside.

Embodiment 1884

The method of embodiment 1883, wherein the modified oligonucleotide comprises at least one nucleoside comprising a 2'-O(CH$_2$)$_2$OCH$_3$ modification.

Embodiment 1885

The method of embodiment 1883 or 1884, wherein the modified oligonucleotide comprises at least on nucleoside comprising a 2'-OCH$_3$ modification.

Embodiment 1886

The method of any of embodiments 1878 to 1885, wherein the modified oligonucleotide comprises at least one bicyclic nucleoside.

Embodiment 1887

The method of embodiment 1886 comprising a (4'-CH$_2$—O-2') BNA nucleoside.

Embodiment 1888

The method of embodiment 1886 or 1887 comprising a (4'-(CH$_2$)$_2$—O-2') BNA nucleoside.

Embodiment 1889

The method of embodiment any of embodiments 1886 to 1888 (4'-C(CH$_3$)H—O-2') BNA nucleoside.

Embodiment 1890

The method of any of embodiments 1878 to 1889 wherein each nucleoside of the modified oligonucleotide is a modified nucleoside.

Embodiment 1891

The method of embodiment 1890 wherein each modified nucleoside of the modified oligonucleotide comprises the same modification.

Embodiment 1892

The method of embodiment 1890 wherein at least two modified nucleosides of the modified oligonucleotide comprise modifications that are different from one another.

Embodiment 1893

The method of any of embodiments 1878 to 1889 or 1891 to 1892 wherein at least one nucleoside of the modified oligonucleotide is an unmodified deoxynucleotide.

Embodiment 1894

The method of any of embodiments 1878 to 1893, wherein the conjugate comprises the following structure:

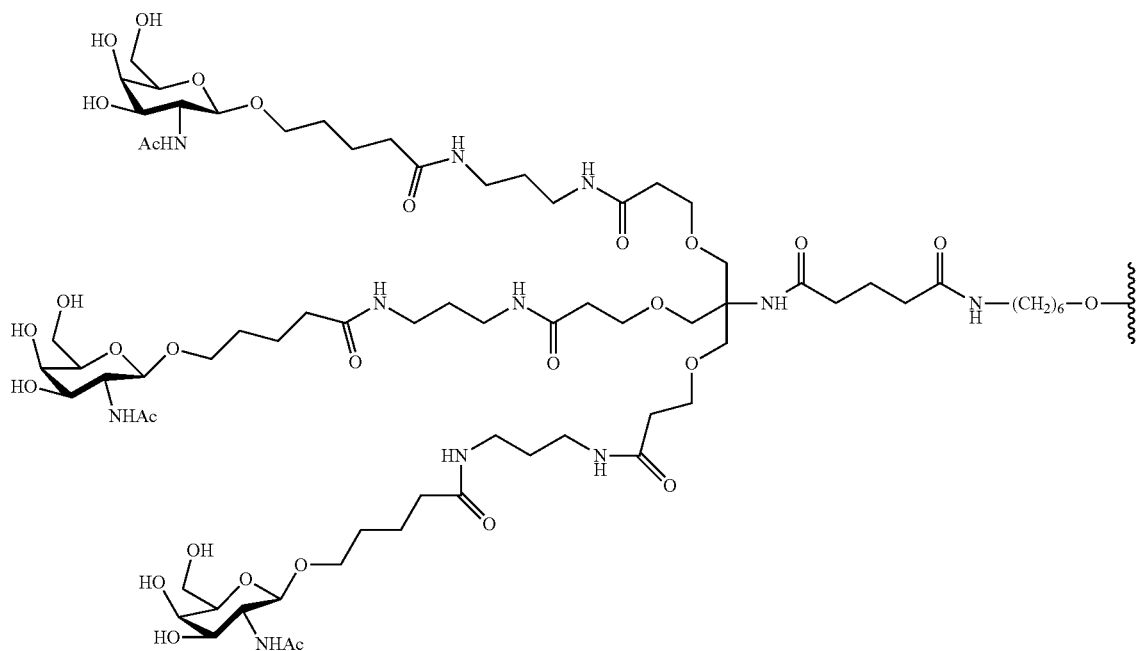

Embodiment 1895

The method of any of embodiments 1878 to 1893, wherein the conjugate comprises the following structure:

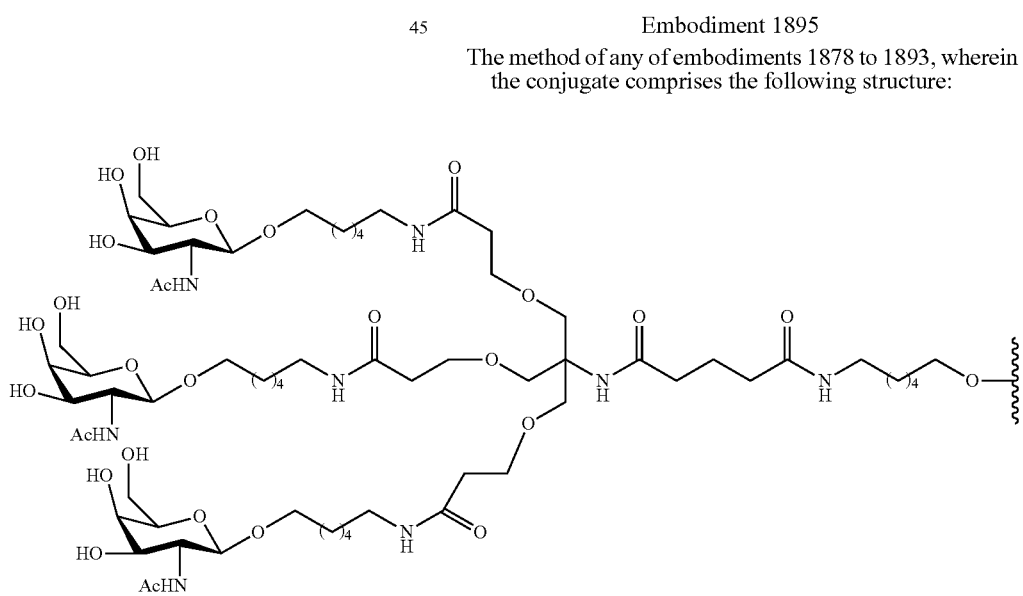

Embodiment 1896
The method of any of embodiments 1878 to 1893, wherein the conjugate comprises the following structure:
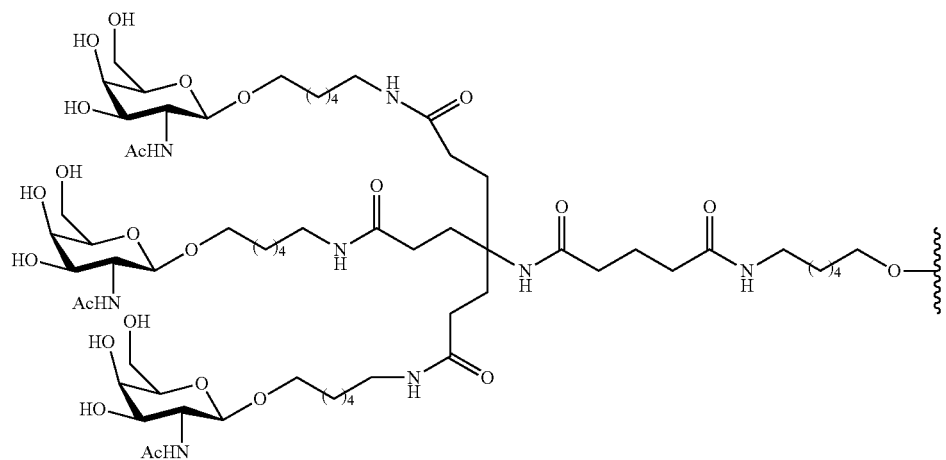
Embodiment 1897
The method of any of embodiments 1878 to 1893, wherein the conjugate comprises the following structure:
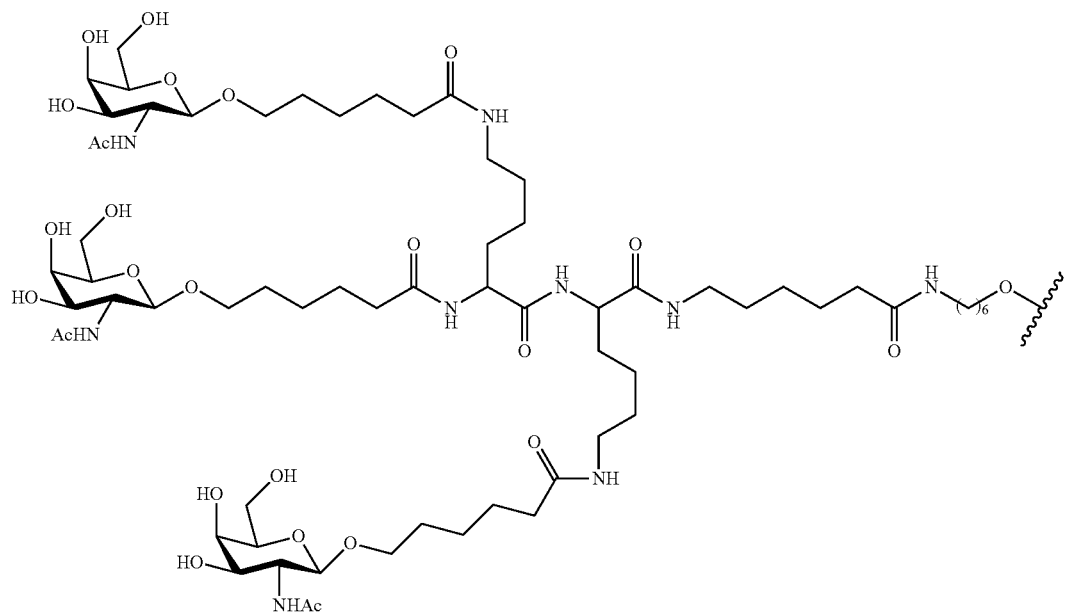

505

Embodiment 1898

The method of any of embodiments 1878 to 1893, wherein the conjugate comprises the following structure:

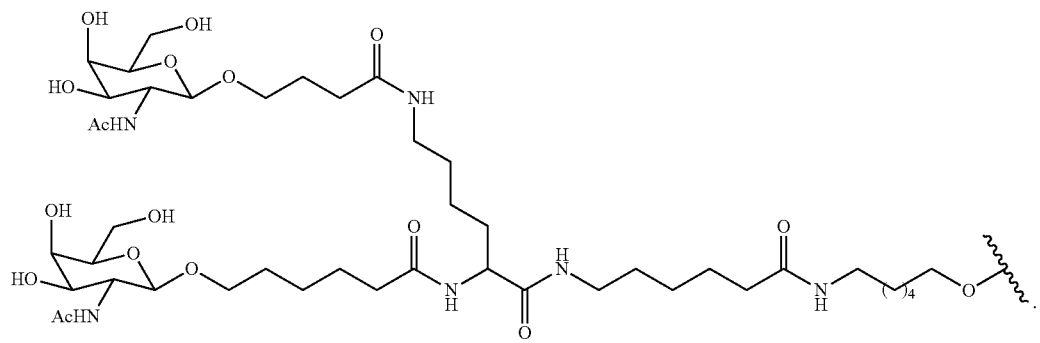

Embodiment 1899

The method of any of embodiments 1878 to 1893, wherein the conjugate comprises the following structure:

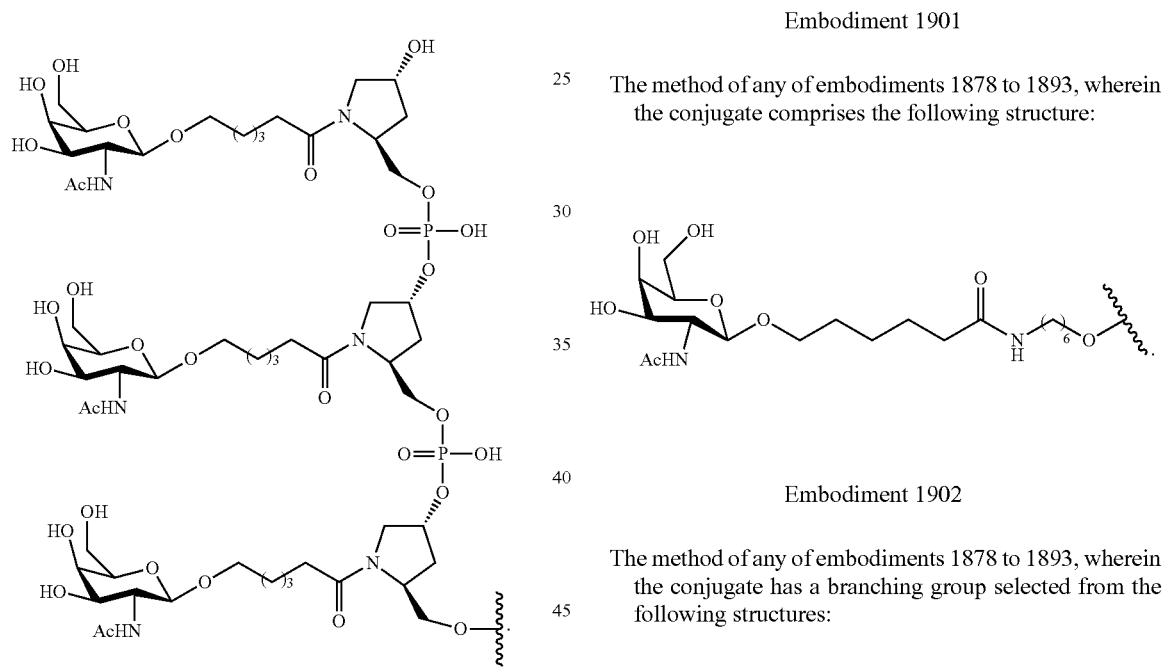

506

Embodiment 1900

The method of any of embodiments 1878 to 1893, wherein the conjugate comprises the following structure:

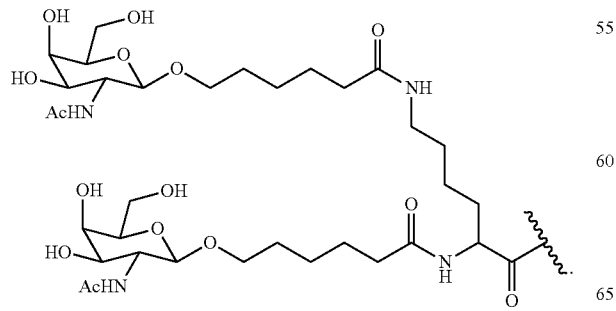

Embodiment 1901

The method of any of embodiments 1878 to 1893, wherein the conjugate comprises the following structure:

Embodiment 1902

The method of any of embodiments 1878 to 1893, wherein the conjugate has a branching group selected from the following structures:

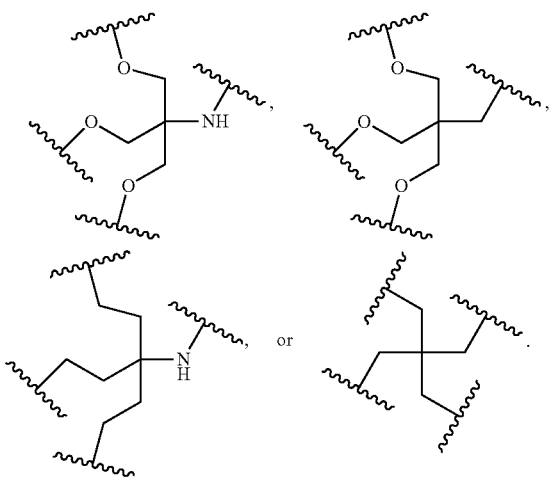

Embodiment 1903

The method of any of embodiments 1878 to 1893, wherein the conjugate has a linker selected from the following structures:

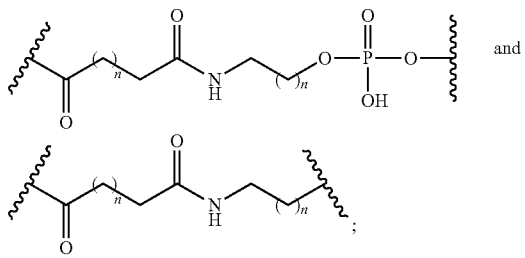

and wherein each n is independently selected from 0, 1, 2, 3, 4, 5, 6, or 7.

Embodiment 1904

The method of any of embodiments 1878 to 1903, wherein the modified oligonucleotide comprises at least one modified internucleoside linkage.

Embodiment 1905

The method of embodiment 1904, wherein the modified internucleoside linkage is a phosphorothioate internucleoside linkage.

Embodiment 1906

The method of embodiment 1904 or 1905, wherein the modified oligonucleotide comprises at least one phosphodiester internucleoside linkage.

Embodiment 1907

The method of embodiment 1904 or 1905, wherein the modified oligonucleotide comprises at least 2 phosphodiester internucleoside linkages.

Embodiment 1908

The method of embodiment 1904 or 1905, wherein the modified oligonucleotide comprises at least 3 phosphodiester internucleoside linkages.

Embodiment 1909

The method of embodiment 1904 or 1905, wherein the modified oligonucleotide comprises at least 4 phosphodiester internucleoside linkages.

Embodiment 1910

The method of embodiment 1904 or 1905, wherein the modified oligonucleotide comprises at least 5 phosphodiester internucleoside linkages.

Embodiment 1911

The method of embodiment 1904 or 1905, wherein the modified oligonucleotide comprises at least 6 phosphodiester internucleoside linkages.

Embodiment 1912

The method of embodiment 1904 or 1905, wherein the modified oligonucleotide comprises at least 7 phosphodiester internucleoside linkages.

Embodiment 1913

The method of any of embodiments 1904 or 1905, wherein each internucleoside linkage of the modified oligonucleotide is selected from a phosphodiester internucleoside linkage and a phosphorothioate internucleoside linkage.

Embodiment 1914

The method of embodiment 1913, wherein each internucleoside linkage of the modified oligonucleotide is a phosphorothioate internucleoside linkage.

Embodiment 1915

The method of any of embodiments 1878 to 1913, wherein at least one nucleoside of the modified oligonucleotide is a morpholino nucleoside.

Embodiment 1916

The method of any of embodiments 1878 to 1913, wherein each nucleoside of the modified oligonucleotide is a morpholino nucleoside.

Embodiment 1917

A prodrug comprising an antisense oligonucleotide and a conjugate, wherein the conjugate comprises at least one GalNAc and the antisense oligonucleotide is an RNAse H based antisense oligonucleotide.

Embodiment 1918

The prodrug of embodiment 1917, wherein the RNase H based antisense oligonucleotide is a gapmer.

Embodiment 1919

The prodrug of embodiment 1917 or 1918, wherein the conjugate is attached to the antisense oligonucleotide at the 5'-end of the antisense oligonucleotide.

Embodiment 1920

A prodrug comprising an antisense oligonucleotide and a conjugate, wherein the conjugate comprises at least one GalNAc and the antisense oligonucleotide is an antisense oligonucleotide that alters splicing of a pre-mRNA.

Embodiment 1921

The prodrug of any of embodiments 1917 to 1920, wherein in vivo metabolism of the prodrug results in the antisense oligonucleotide lacking the conjugate.

Embodiment 1922

The prodrug of any of embodiments 1917 to 1921, wherein the prodrug is at least 5 times more potent in vivo than the antisense oligonucleotide lacking the conjugate.

Embodiment 1923

The prodrug of any of embodiments 1917 to 1921, wherein the prodrug is at least 8 times more potent in vivo than the antisense oligonucleotide lacking the conjugate.

Embodiment 1924

The prodrug of any of embodiments 1917 to 1921, wherein the prodrug is at least 10 times more potent in vivo than the antisense oligonucleotide lacking the conjugate.

Embodiment 1925

A method comprising administering the prodrug of any of embodiments 1917 to 1924 to an animal.

Embodiment 1926

A compound comprising an antisense oligonucleotide and a conjugate, wherein the conjugate comprises at least one GalNAc, wherein the antisense oligonucleotide has a gapmer sugar motif, and wherein the nucleobase sequence of the antisense oligonucleotide is not 100% complementary to a target nucleic acid selected from among: mouse Raf Kinase C, mouse Fas receptor, or human Phosphatase and Tensin Homolog (PTEN).

Embodiment 1927

The compound of embodiment 1926, wherein the conjugate is attached to the 5'-end of the antisense oligonucleotide.

Embodiment 1928

The compound of any of embodiments 1926 or 1927, wherein the internucleoside linkages of the antisense oligonucleotide comprise at least one phosphodiester linkage and at least one phosphorothioate linkage.

Embodiment 1929

The compound of any of embodiments 1926 to 1928, wherein the conjugate group does not comprise cholane.

Embodiment 1930

The compound of any of embodiments 1926 to 1929, wherein the branching group comprises a quaternary carbon or an amino acid.

Embodiment 1931

A compound comprising an antisense oligonucleotide and a conjugate, wherein the conjugate comprises at least one GalNAc, wherein the antisense oligonucleotide has a gapmer sugar motif, and wherein the nucleobase sequence of the antisense oligonucleotide is complementary to a target nucleic acid which may be modulated for the treatment of a metabolic or cardiovascular disorder.

Embodiment 1932

The compound of embodiment 1931, wherein the conjugate is attached to the 5'-end of the antisense oligonucleotide.

Embodiment 1933

The compound of any of embodiments 1931 or 1932, wherein the internucleoside linkages of the antisense oligonucleotide comprise at least one phosphodiester linkage and at least one phosphorothioate linkage.

Embodiment 1934

The compound of any of embodiments 1931 to 1933, wherein the conjugate group does not comprise cholane.

Embodiment 1935

The compound of any of embodiments 1931 to 1934, wherein the branching group comprises a quaternary carbon or an amino acid.

Embodiment 1936

A compound comprising an antisense oligonucleotide and a conjugate, wherein the conjugate comprises at least one GalNAc, and wherein the antisense oligonucleotide comprises at least one phosphodiester linkage and at least one phosphorothioate linkage.

Embodiment 1937

The compound of embodiment 1936, wherein the conjugate is attached to the 5'-end of the antisense oligonucleotide.

Embodiment 1938

The compound of any of embodiments 1936 or 1937, wherein the antisense oligonucleotide has a gapmer sugar motif.

Embodiment 1939

The compound of any of embodiments 1936 to 1938, wherein the conjugate group does not comprise cholane.

Embodiment 1940

The compound of any of embodiments 1936 to 1939, wherein the branching group comprises a quaternary carbon or an amino acid.

Embodiment 1941

A compound comprising an antisense oligonucleotide and a conjugate, wherein the conjugate comprises at least one GalNAc, wherein the conjugate group does not comprise cholane; and wherein the antisense oligonucleotide has a gapmer sugar motif.

Embodiment 1942

The compound of embodiment 1941, wherein the conjugate is attached to the 5'-end of the antisense oligonucleotide.

Embodiment 1943

The compound of any of embodiments 1941 or 1942, wherein the internucleoside linkages of the antisense oligonucleotide comprise at least one phosphodiester linkage and at least one phosphorothioate linkage.

Embodiment 1944

The compound of any of embodiments 1941 to 1943, wherein the branching group comprises a quaternary carbon or an amino acid.

Embodiment 1945

A compound comprising an antisense oligonucleotide and a conjugate, wherein the conjugate comprises at least one GalNAc, wherein the antisense oligonucleotide has a gapmer sugar motif, and wherein the branching group comprises a quaternary carbon or an amino acid.

Embodiment 1946

The compound of embodiment 1945, wherein the conjugate is attached to the 5'-end of the antisense oligonucleotide.

Embodiment 1947

The compound of any of embodiments 1945 or 1946, wherein the internucleoside linkages of the antisense oligonucleotide comprise at least one phosphodiester linkage and at least one phosphorothioate linkage.

Embodiment 1948

The compound of any of embodiments 1945 to 1957, wherein the conjugate group does not comprise cholane.

Embodiment 1949

A compound comprising an antisense oligonucleotide and a conjugate, wherein the conjugate comprises at least one GalNAc, and wherein the antisense oligonucleotide alters splicing of a pre-mRNA.

Embodiment 1950

The compound of any of embodiments 1926 to 1949, wherein the antisense oligonucleotide consists of 10 to 30 linked nucleosides.

Embodiment 1951

The compound of any of embodiments 1926 to 1949, wherein the antisense oligonucleotide consists of 18 to 22 linked nucleosides.

Embodiment 1952

The compound of any of embodiments 1926 to 1949, wherein the antisense oligonucleotide consists of 16 to 20 linked nucleosides.

Embodiment 1953

The method of any of embodiments 1926 to 1949, wherein the modified oligonucleotide consists of 10 to 30 linked nucleosides.

Embodiment 1954

The method of any of embodiments 1926 to 1949, wherein the modified oligonucleotide consists of 18 to 22 linked nucleosides.

Embodiment 1955

The method of any of embodiments 1848 to 1916, wherein the modified oligonucleotide consists of 16 to 20 linked nucleosides.

Embodiment 1956

A compound comprising a cell-targeting moiety that has the following structure:

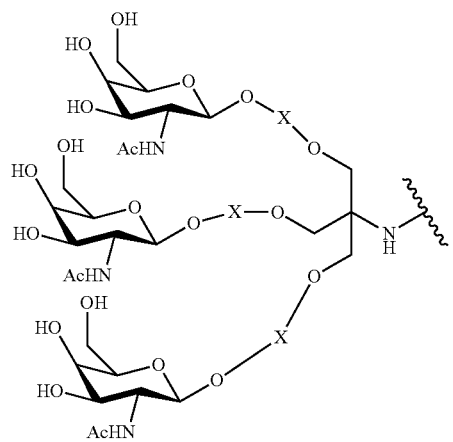

wherein X is a substituted or unsubstituted tether of six to eleven consecutively bonded atoms.

Embodiment 1957

A compound comprising a cell-targeting moiety that has the following structure:

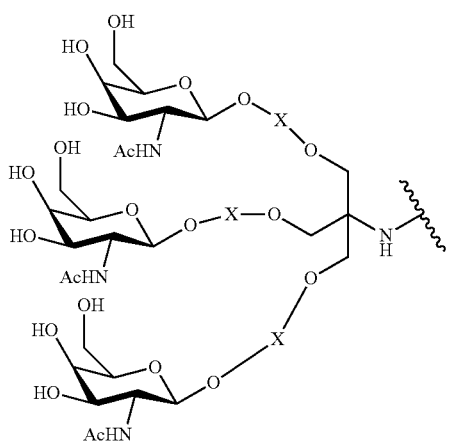

wherein X is a substituted or unsubstituted tether of ten consecutively bonded atoms.

Embodiment 1958

A compound comprising a cell-targeting moiety that has the following structure:

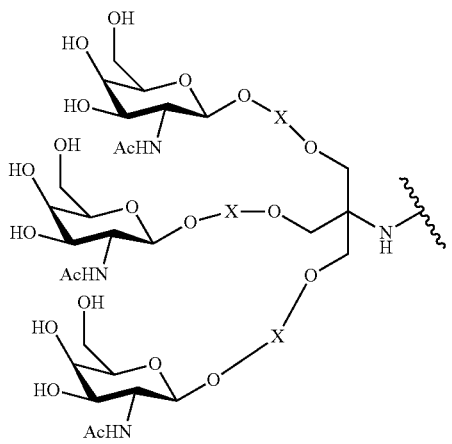

wherein X is a substituted or unsubstituted tether of four to eleven consecutively bonded atoms and wherein the tether comprises exactly one amide bond.

Embodiment 1959

A compound comprising a cell-targeting moiety that has the following structure:

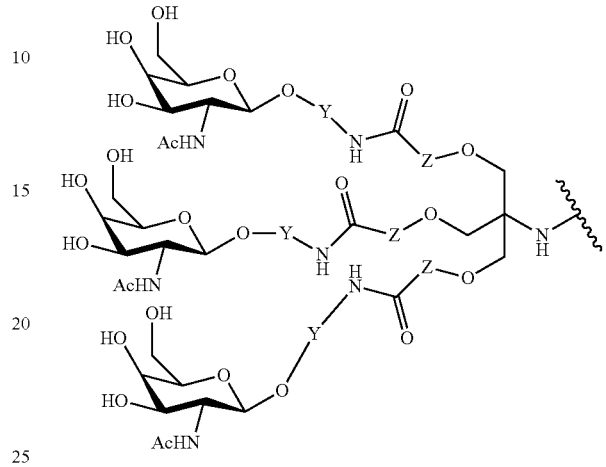

wherein Y and Z are independently selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

Embodiment 1960

A compound comprising a cell-targeting moiety that has the following structure:

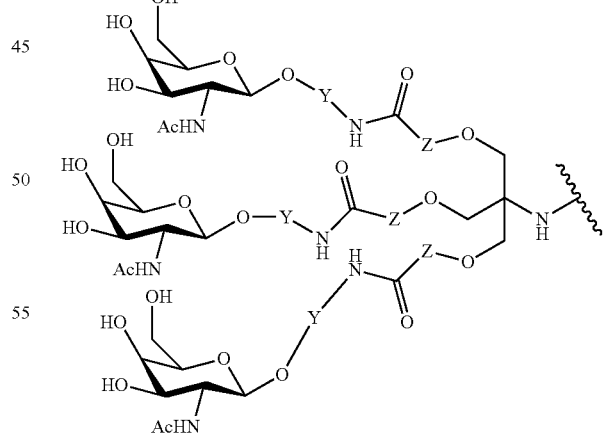

wherein Y and Z are independently selected from a $C_1$-$C_{12}$ substituted or unsubstituted alkyl group, or a group comprising exactly one ether or exactly two ethers, an amide, an amine, a piperidine, a phosphate, a phosphodiester, or a phosphorothioate.

515

Embodiment 1961

A compound comprising a cell-targeting moiety that has the following structure:

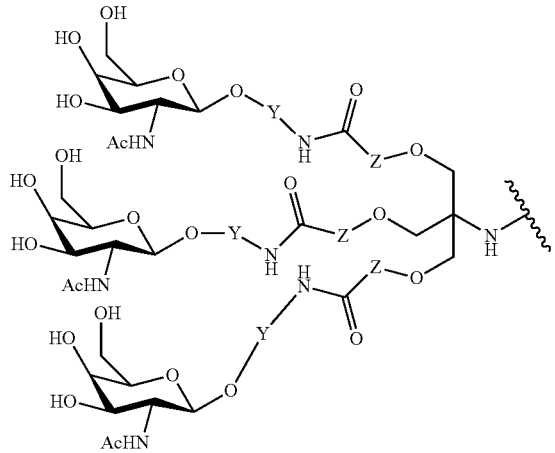

wherein Y and Z are independently selected from a $C_1$-$C_{12}$ substituted or unsubstituted alkyl group.

Embodiment 1962

A compound comprising a cell-targeting moiety that has the following structure:

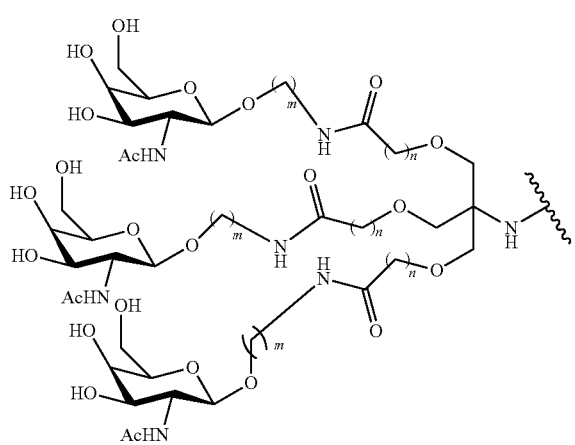

wherein m and n are independently selected from 1, 2, 3, 4, 5, 6, 7, 8, 9, 10, 11, and 12.

516

Embodiment 1963

A compound comprising a cell-targeting moiety that has the following structure:

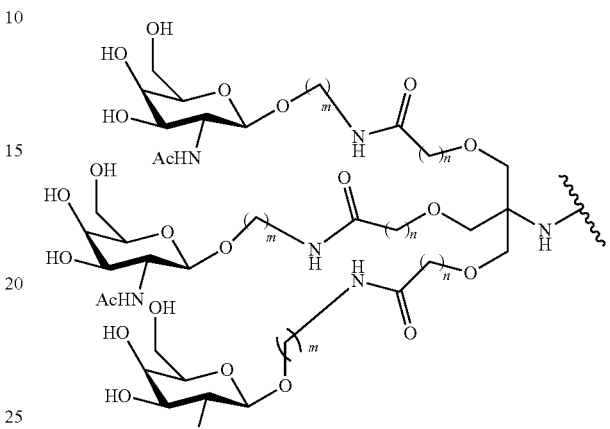

wherein m is 4, 5, 6, 7, or 8, and n is 1, 2, 3, or 4.

Embodiment 1964

A compound comprising a cell-targeting moiety that has the following structure:

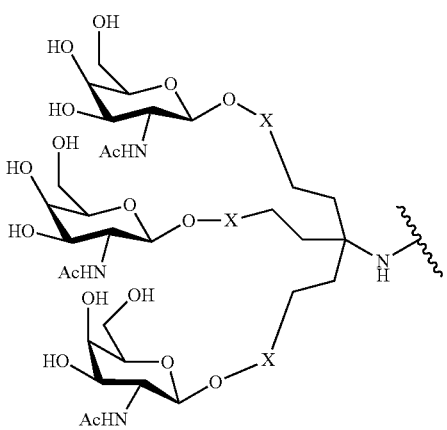

wherein X is a substituted or unsubstituted tether of four to thirteen consecutively bonded atoms, and wherein X does not comprise an ether group.

517

Embodiment 1965

A compound comprising a cell-targeting moiety that has the following structure:

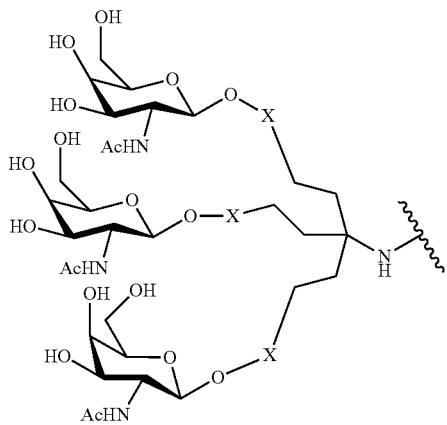

wherein X is a substituted or unsubstituted tether of eight consecutively bonded atoms, and wherein X does not comprise an ether group.

Embodiment 1966

A compound comprising a cell-targeting moiety that has the following structure:

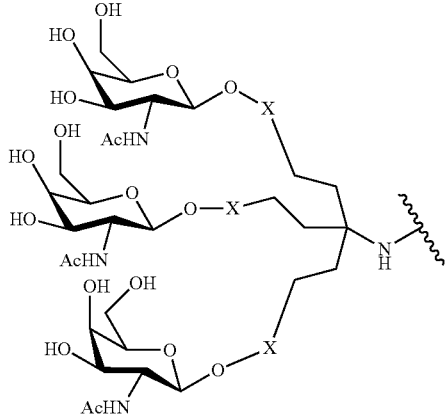

wherein X is a substituted or unsubstituted tether of four to thirteen consecutively bonded atoms, and
wherein the tether comprises exactly one amide bond, and wherein X does not comprise an ether group.

518

Embodiment 1967

A compound comprising a cell-targeting moiety that has the following structure:

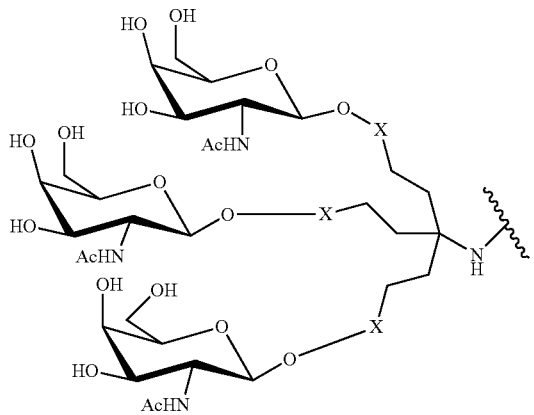

wherein X is a substituted or unsubstituted tether of four to thirteen consecutively bonded atoms and wherein the tether consists of an amide bond and a substituted or unsubstituted $C_2$-$C_{11}$ alkyl group.

Embodiment 1968

A compound comprising a cell-targeting moiety that has the following structure:

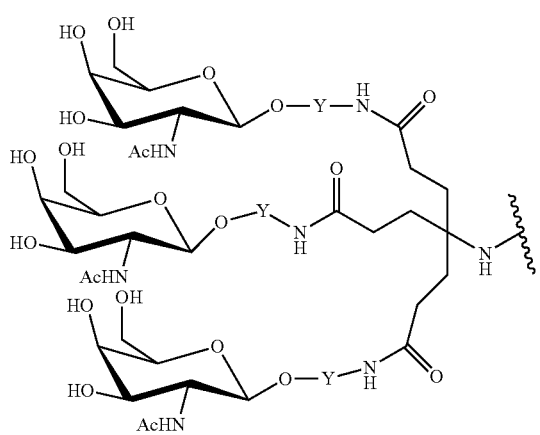

wherein Y is selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

519

Embodiment 1969

A compound comprising a cell-targeting moiety that has the following structure:

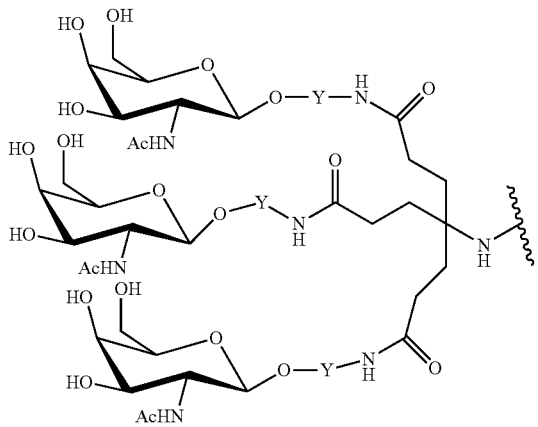

wherein Y is selected from a $C_1$-$C_{12}$ substituted or unsubstituted alkyl group, or a group comprising an ether, an amine, a piperidine, a phosphate, a phosphodiester, or a phosphorothioate.

Embodiment 1970

A compound comprising a cell-targeting moiety that has the following structure:

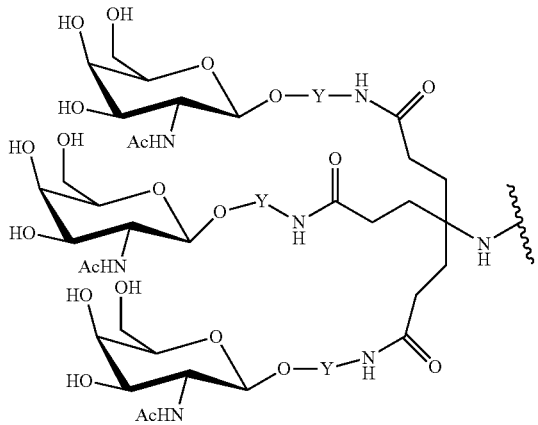

wherein Y is selected from a $C_1$-$C_{12}$ substituted or unsubstituted alkyl group.

520

Embodiment 1971

A compound comprising a cell-targeting moiety that has the following structure:

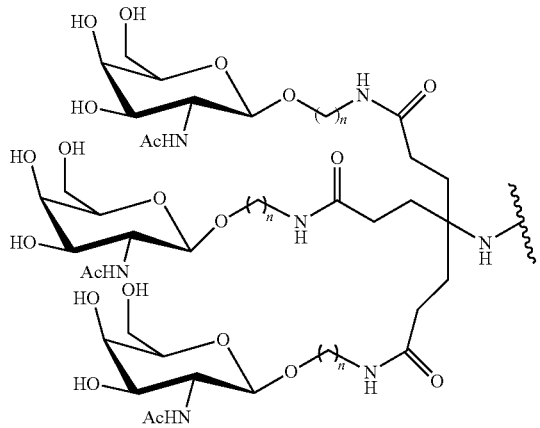

Wherein n is 1, 2, 3, 4, 5, 6, 7, 8, 9, 10, 11, or 12.

Embodiment 1972

A compound comprising a cell-targeting moiety that has the following structure:

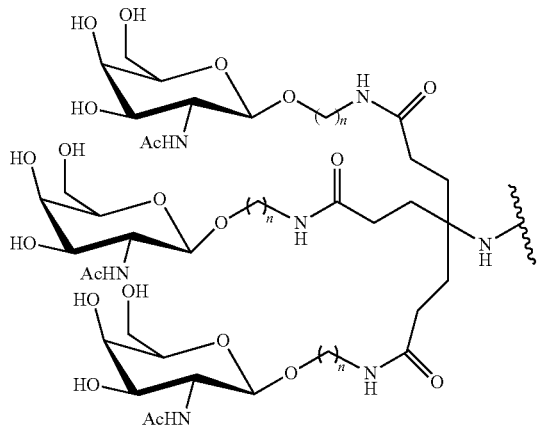

wherein n is 4, 5, 6, 7, or 8.

Embodiment 1973

A conjugated antisense oligonucleotide comprising a conjugate group and an antisense oligonucleotide, wherein the conjugate group comprises exactly one GalNAc, and wherein the conjugate group is attached to the 5' end of the antisense oligonucleotide.

Embodiment 1974

A conjugated antisense oligonucleotide comprising a conjugate group and an antisense oligonucleotide, wherein the conjugate group comprises exactly two GalNAc ligands, and wherein the conjugate group is attached to the 5' end of the antisense oligonucleotide.

Embodiment 1975

A conjugated antisense oligonucleotide comprising a conjugate group and an antisense oligonucleotide, wherein the conjugate group comprises exactly one GalNAc, and wherein the conjugate group is attached to the 3' end of the antisense oligonucleotide.

Embodiment 1976

A conjugated antisense oligonucleotide comprising a conjugate group and an antisense oligonucleotide, wherein the conjugate group comprises exactly two GalNAc ligands, and wherein the conjugate group is attached to the 3' end of the antisense oligonucleotide.

Embodiment 1977

A conjugated antisense oligonucleotide comprising a conjugate group and an antisense oligonucleotide, wherein the conjugate group comprises 1-4 GalNAc ligands, and wherein the antisense oligonucleotide is a gapmer.

Embodiment 1978

The conjugated antisense oligonucleotide of embodiment 1977, wherein the conjugate group is attached to the 5' end of the antisense oligonucleotide.

Embodiment 1979

The conjugated antisense oligonucleotide of any of embodiments 1977-1978, wherein the conjugate group comprises a linker that does not comprise a disulfide.

Embodiment 1980

The conjugated antisense oligonucleotide of any of embodiments 1977-1979, wherein the conjugate group comprises a linker that does not comprise a thioether.

Embodiment 1981

The conjugated antisense oligonucleotide of any of embodiments 1977-1980, wherein the conjugate group comprises a linker that does not comprise a pyrrolidine.

Embodiment 1982

The conjugated antisense oligonucleotide of any of embodiments 1977-1981, wherein the conjugate group does not comprise a polycyclic moiety.

Embodiment 1983

The conjugated antisense oligonucleotide of any of embodiments 1977-1981, wherein the conjugate group comprises a branching group that does not comprise a polycyclic moiety.

Embodiment 1984

The conjugated antisense oligonucleotide of any of embodiments 1977-1983, wherein the conjugate group comprises a linker that does not comprise a lipid moiety.

Embodiment 1985

The conjugated antisense oligonucleotide of any of embodiments 1977-1984, wherein the linkage between the conjugate group and the antisense oligonucleotide is not a phosphorothioate group.

Embodiment 1986

The conjugated antisense oligonucleotide of any of embodiments 1977-1985, wherein the antisense oligonucleotide comprises at least one modified nucleoside, wherein the modified nucleoside is a 2'-O-methoxyethyl (MOE) modified nucleoside.

Embodiment 1987

The conjugated antisense oligonucleotide of any of embodiments 1977-1986, wherein the antisense oligonucleotide comprises at least one modified nucleoside, wherein the modified nucleoside is a cEt modified nucleoside.

Embodiment 1988

The conjugated antisense oligonucleotide of any of embodiments 1977-1987, wherein the antisense oligonucleotide comprises at least one phosphorothioate internucleoside linkage and at least one phosphodiester internucleoside linkage.

Embodiment 1989

The conjugated antisense oligonucleotide of any of embodiments 1977-1987,
wherein the wings of the gapmer comprise at least two different sugar modifications.

Embodiment 1990

The conjugated antisense oligonucleotide of any of embodiments 1977-1989, wherein the sequence of the antisense oligonucleotide is selected from SEQ ID NO.'s 17-159.

Embodiment 1991

A conjugated antisense oligonucleotide comprising a conjugate group and an antisense oligonucleotide, wherein the conjugate group comprises the cell-targeting moiety of any of embodiments 1956-1972.

Embodiment 1992

A conjugated antisense oligonucleotide comprising a conjugate group and an antisense oligonucleotide, wherein the conjugate group comprises the cell-targeting moiety of any of embodiments 1956-1972, and wherein the antisense oligonucleotide comprises a gapmer.

Embodiment 1993

A conjugated antisense oligonucleotide comprising a conjugate group and an antisense oligonucleotide, wherein the conjugate group comprises the cell-targeting moiety of any of embodiments 1956-1972, and wherein the sugars of the antisense oligonucleotide are uniformly modified.

Embodiment 1994

A conjugated antisense oligonucleotide comprising a conjugate group and an antisense oligonucleotide, wherein the conjugate group comprises the cell-targeting moiety of any of embodiments 1956-1972, and wherein the antisense oligonucleotide is single stranded.

Embodiment 1995

A conjugated antisense oligonucleotide comprising a conjugate group and an antisense oligonucleotide, wherein the conjugate group comprises the cell-targeting moiety of any of embodiments 1956-1972, and wherein the antisense oligonucleotide is double stranded.

Embodiment 1996

The conjugated antisense oligonucleotide of any of embodiments 1991-1995, wherein the conjugate is attached to the 5' end of the antisense oligonucleotide.

Embodiment 1997

The conjugated antisense oligonucleotide of any of embodiments 1991-1995, wherein the conjugate is attached to the 3' end of the antisense oligonucleotide.

Embodiment 1998

A conjugated antisense oligonucleotide comprising a conjugate group and an antisense oligonucleotide, wherein the conjugate group comprises 1-4 GalNAc ligands, and wherein the sugars of the antisense oligonucleotide are uniformly modified.

In embodiments having more than one of a particular variable (e.g., more than one "m" or "n"), unless otherwise indicated, each such particular variable is selected independently. Thus, for a structure having more than one n, each n is selected independently, so they may or may not be the same as one another.

DETAILED DESCRIPTION

It is to be understood that both the foregoing general description and the following detailed description are exemplary and explanatory only and are not restrictive of the disclosure. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference in their entirety for any purpose.

A. Definitions

Unless specific definitions are provided, the nomenclature used in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., $21^{st}$ edition, 2005; and "Antisense Drug Technology, Principles, Strategies, and Applications" Edited by Stanley T. Crooke, CRC Press, Boca Raton, Fla.; and Sambrook et al., "Molecular Cloning, A laboratory Manual," $2^{nd}$ Edition, Cold Spring Harbor Laboratory Press, 1989, which are hereby incorporated by reference for any purpose. Where permitted, all patents, applications, published applications and other publications and other data referred to throughout in the disclosure are incorporated by reference herein in their entirety.

Unless otherwise indicated, the following terms have the following meanings:

As used herein, "nucleoside" means a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety.

As used herein, "chemical modification" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

As used herein, "furanosyl" means a structure comprising a 5-membered ring comprising four carbon atoms and one oxygen atom.

As used herein, "naturally occurring sugar moiety" means a ribofuranosyl as found in naturally occurring RNA or a deoxyribofuranosyl as found in naturally occurring DNA.

As used herein, "sugar moiety" means a naturally occurring sugar moiety or a modified sugar moiety of a nucleoside.

As used herein, "modified sugar moiety" means a substituted sugar moiety or a sugar surrogate.

As used herein, "substituted sugar moiety" means a furanosyl that is not a naturally occurring sugar moiety. Substituted sugar moieties include, but are not limited to furanosyls comprising substituents at the 2'-position, the 3'-position, the 5'-position and/or the 4'-position. Certain substituted sugar moieties are bicyclic sugar moieties.

As used herein, "2'-substituted sugar moiety" means a furanosyl comprising a substituent at the 2'-position other than H or OH. Unless otherwise indicated, a 2'-substituted sugar moiety is not a bicyclic sugar moiety (i.e., the 2'-substituent of a 2'-substituted sugar moiety does not form a bridge to another atom of the furanosyl ring.

As used herein, "MOE" means —$OCH_2CH_2OCH_3$.

As used herein, "2'-F nucleoside" refers to a nucleoside comprising a sugar comprising fluorine at the 2' position. Unless otherwise indicated, the fluorine in a 2'-F nucleoside is in the ribo position (replacing the OH of a natural ribose).

As used herein the term "sugar surrogate" means a structure that does not comprise a furanosyl and that is capable of replacing the naturally occurring sugar moiety of a nucleoside, such that the resulting nucleoside sub-units are capable of linking together and/or linking to other nucleosides to form an oligomeric compound which is capable of hybridizing to a complementary oligomeric compound. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholinos, cyclohexenyls and cyclohexitols.

As used herein, "bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

As used herein, "nucleotide" means a nucleoside further comprising a phosphate linking group. As used herein, "linked nucleosides" may or may not be linked by phosphate linkages and thus includes, but is not limited to "linked nucleotides." As used herein, "linked nucleosides" are nucleosides that are connected in a continuous sequence (i.e. no additional nucleosides are present between those that are linked).

As used herein, "nucleobase" means a group of atoms that can be linked to a sugar moiety to create a nucleoside that is capable of incorporation into an oligonucleotide, and wherein the group of atoms is capable of bonding with a complementary naturally occurring nucleobase of another oligonucleotide or nucleic acid. Nucleobases may be naturally occurring or may be modified.

As used herein the terms, "unmodified nucleobase" or "naturally occurring nucleobase" means the naturally occurring heterocyclic nucleobases of RNA or DNA: the purine bases adenine (A) and guanine (G), and the pyrimidine bases thymine (T), cytosine (C) (including 5-methyl C), and uracil (U).

As used herein, "modified nucleobase" means any nucleobase that is not a naturally occurring nucleobase.

As used herein, "modified nucleoside" means a nucleoside comprising at least one chemical modification compared to naturally occurring RNA or DNA nucleosides. Modified nucleosides comprise a modified sugar moiety and/or a modified nucleobase.

As used herein, "bicyclic nucleoside" or "BNA" means a nucleoside comprising a bicyclic sugar moiety.

As used herein, "constrained ethyl nucleoside" or "cEt" means a nucleoside comprising a bicyclic sugar moiety comprising a 4'-CH(CH$_3$)—O-2' bridge.

As used herein, "locked nucleic acid nucleoside" or "LNA" means a nucleoside comprising a bicyclic sugar moiety comprising a 4'-CH$_2$—O-2' bridge.

As used herein, "2'-substituted nucleoside" means a nucleoside comprising a substituent at the 2'-position other than H or OH. Unless otherwise indicated, a 2'-substituted nucleoside is not a bicyclic nucleoside.

As used herein, "deoxynucleoside" means a nucleoside comprising 2'-H furanosyl sugar moiety, as found in naturally occurring deoxyribonucleosides (DNA). In certain embodiments, a 2'-deoxynucleoside may comprise a modified nucleobase or may comprise an RNA nucleobase (e.g., uracil).

As used herein, "oligonucleotide" means a compound comprising a plurality of linked nucleosides. In certain embodiments, an oligonucleotide comprises one or more unmodified ribonucleosides (RNA) and/or unmodified deoxyribonucleosides (DNA) and/or one or more modified nucleosides.

As used herein "oligonucleoside" means an oligonucleotide in which none of the internucleoside linkages contains a phosphorus atom. As used herein, oligonucleotides include oligonucleosides.

As used herein, "modified oligonucleotide" means an oligonucleotide comprising at least one modified nucleoside and/or at least one modified internucleoside linkage.

As used herein, "linkage" or "linking group" means a group of atoms that link together two or more other groups of atoms.

As used herein "internucleoside linkage" means a covalent linkage between adjacent nucleosides in an oligonucleotide.

As used herein "naturally occurring internucleoside linkage" means a 3' to 5' phosphodiester linkage.

As used herein, "modified internucleoside linkage" means any internucleoside linkage other than a naturally occurring internucleoside linkage.

As used herein, "terminal internucleoside linkage" means the linkage between the last two nucleosides of an oligonucleotide or defined region thereof.

As used herein, "phosphorus linking group" means a linking group comprising a phosphorus atom. Phosphorus linking groups include without limitation groups having the formula:

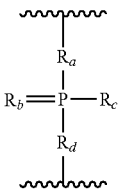

wherein:
$R_a$ and $R_d$ are each, independently, O, S, CH$_2$, NH, or NJ$_1$ wherein J$_1$ is C$_1$-C$_6$ alkyl or substituted C$_1$-C$_6$ alkyl;
$R_b$ is O or S;
$R_c$ is OH, SH, C$_1$-C$_6$ alkyl, substituted C$_1$-C$_6$ alkyl, C$_1$-C$_6$ alkoxy, substituted C$_1$-C$_6$ alkoxy, amino or substituted amino; and
J$_1$ is R$_b$ is O or S.

Phosphorus linking groups include without limitation, phosphodiester, phosphorothioate, phosphorodithioate, phosphonate, phosphoramidate, phosphorothioamidate, thionoalkylphosphonate, phosphotriesters, thionoalkylphosphotriester and boranophosphate.

As used herein, "internucleoside phosphorus linking group" means a phosphorus linking group that directly links two nucleosides.

As used herein, "non-internucleoside phosphorus linking group" means a phosphorus linking group that does not directly link two nucleosides. In certain embodiments, a non-internucleoside phosphorus linking group links a nucleoside to a group other than a nucleoside. In certain embodiments, a non-internucleoside phosphorus linking group links two groups, neither of which is a nucleoside.

As used herein, "neutral linking group" means a linking group that is not charged. Neutral linking groups include without limitation phosphotriesters, methylphosphonates, MMI (—CH$_2$—N(CH$_3$)—O—), amide-3 (—CH$_2$—C (=O)—N(H)—), amide-4 (—CH$_2$—N(H)—C(=O)—), formacetal (—O—CH$_2$—O—), and thioformacetal (—S—CH$_2$—O—). Further neutral linking groups include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook Eds. ACS Symposium Series 580; Chapters 3 and 4, (pp. 40-65)). Further neutral linking groups include nonionic linkages comprising mixed N, O, S and CH$_2$ component parts.

As used herein, "internucleoside neutral linking group" means a neutral linking group that directly links two nucleosides.

As used herein, "non-internucleoside neutral linking group" means a neutral linking group that does not directly link two nucleosides. In certain embodiments, a non-internucleoside neutral linking group links a nucleoside to a group other than a nucleoside. In certain embodiments, a non-internucleoside neutral linking group links two groups, neither of which is a nucleoside.

As used herein, "oligomeric compound" means a polymeric structure comprising two or more sub-structures. In certain embodiments, an oligomeric compound comprises an oligonucleotide. In certain embodiments, an oligomeric compound comprises one or more conjugate groups and/or terminal groups. In certain embodiments, an oligomeric compound consists of an oligonucleotide. Oligomeric compounds also include naturally occurring nucleic acids. In certain embodiments, an oligomeric compound comprises a backbone of one or more linked monomeric subunits where each linked monomeric subunit is directly or indirectly attached to a heterocyclic base moiety. In certain embodiments, oligomeric compounds may also include monomeric subunits that are not linked to a heterocyclic base moiety, thereby providing abasic sites. In certain embodiments, the linkages joining the monomeric subunits, the sugar moieties or surrogates and the heterocyclic base moieties can be independently modified. In certain embodiments, the linkage-sugar unit, which may or may not include a heterocyclic base, may be substituted with a mimetic such as the monomers in peptide nucleic acids.

As used herein, "terminal group" means one or more atom attached to either, or both, the 3' end or the 5' end of an oligonucleotide. In certain embodiments a terminal group is a conjugate group. In certain embodiments, a terminal group comprises one or more terminal group nucleosides.

As used herein, "conjugate" or "conjugate group" means an atom or group of atoms bound to an oligonucleotide or oligomeric compound. In general, conjugate groups modify one or more properties of the compound to which they are attached, including, but not limited to pharmacodynamic, pharmacokinetic, binding, absorption, cellular distribution, cellular uptake, charge and/or clearance properties.

As used herein, "conjugate linker" or "linker" in the context of a conjugate group means a portion of a conjugate group comprising any atom or group of atoms and which covalently link (1) an oligonucleotide to another portion of the conjugate group or (2) two or more portions of the conjugate group.

Conjugate groups are shown herein as radicals, providing a bond for forming covalent attachment to an oligomeric compound such as an antisense oligonucleotide. In certain embodiments, the point of attachment on the oligomeric compound is the 3'-oxygen atom of the 3'-hydroxyl group of the 3' terminal nucleoside of the oligomeric compound. In certain embodiments the point of attachment on the oligomeric compound is the 5'-oxygen atom of the 5'-hydroxyl group of the 5' terminal nucleoside of the oligomeric compound. In certain embodiments, the bond for forming attachment to the oligomeric compound is a cleavable bond. In certain such embodiments, such cleavable bond constitutes all or part of a cleavable moiety.

In certain embodiments, conjugate groups comprise a cleavable moiety (e.g., a cleavable bond or cleavable nucleoside) and a carbohydrate cluster portion, such as a GalNAc cluster portion. Such carbohydrate cluster portion comprises: a targeting moiety and, optionally, a conjugate linker. In certain embodiments, the carbohydrate cluster portion is identified by the number and identity of the ligand. For example, in certain embodiments, the carbohydrate cluster portion comprises 3 GalNAc groups and is designated "GalNAc$_3$". In certain embodiments, the carbohydrate cluster portion comprises 4 GalNAc groups and is designated "GalNAc$_4$". Specific carbohydrate cluster portions (having specific tether, branching and conjugate linker groups) are described herein and designated by Roman numeral followed by subscript "a". Accordingly "GalNac3-1$_a$" refers to a specific carbohydrate cluster portion of a conjugate group having 3 GalNac groups and specifically identified tether, branching and linking groups. Such carbohydrate cluster fragment is attached to an oligomeric compound via a cleavable moiety, such as a cleavable bond or cleavable nucleoside.

As used herein, "cleavable moiety" means a bond or group that is capable of being cleaved under physiological conditions. In certain embodiments, a cleavable moiety is cleaved inside a cell or sub-cellular compartments, such as an endosome or lysosome. In certain embodiments, a cleavable moiety is cleaved by endogenous enzymes, such as nucleases. In certain embodiments, a cleavable moiety comprises a group of atoms having one, two, three, four, or more than four cleavable bonds. In certain embodiments, a cleavable moiety is a phosphodiester linkage.

As used herein, "cleavable bond" means any chemical bond capable of being broken. In certain embodiments, a cleavable bond is selected from among: an amide, a polyamide, an ester, an ether, one or both esters of a phosphodiester, a phosphate ester, a carbamate, a di-sulfide, or a peptide.

As used herein, "carbohydrate cluster" means a compound having one or more carbohydrate residues attached to a scaffold or linker group. (see, e.g., Maier et al., "Synthesis of Antisense Oligonucleotides Conjugated to a Multivalent Carbohydrate Cluster for Cellular Targeting," *Bioconjugate Chemistry*, 2003, (14): 18-29, which is incorporated herein by reference in its entirety, or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, (47): 5798-5808, for examples of carbohydrate conjugate clusters).

As used herein, "modified carbohydrate" means any carbohydrate having one or more chemical modifications relative to naturally occurring carbohydrates.

As used herein, "carbohydrate derivative" means any compound which may be synthesized using a carbohydrate as a starting material or intermediate.

As used herein, "carbohydrate" means a naturally occurring carbohydrate, a modified carbohydrate, or a carbohydrate derivative.

As used herein "protecting group" means any compound or protecting group known to those having skill in the art. Non-limiting examples of protecting groups may be found in "Protective Groups in Organic Chemistry", T. W. Greene, P. G. M. Wuts, ISBN 0-471-62301-6, John Wiley & Sons, Inc, New York, which is incorporated herein by reference in its entirety.

As used herein, "single-stranded" means an oligomeric compound that is not hybridized to its complement and which lacks sufficient self-complementarity to form a stable self-duplex.

As used herein, "double stranded" means a pair of oligomeric compounds that are hybridized to one another or a single self-complementary oligomeric compound that forms a hairpin structure. In certain embodiments, a double-stranded oligomeric compound comprises a first and a second oligomeric compound.

As used herein, "antisense compound" means a compound comprising or consisting of an oligonucleotide at least a portion of which is complementary to a target nucleic acid to which it is capable of hybridizing, resulting in at least one antisense activity.

As used herein, "antisense activity" means any detectable and/or measurable change attributable to the hybridization of an antisense compound to its target nucleic acid. In certain embodiments, antisense activity includes modulation of the amount or activity of a target nucleic acid transcript (e.g. mRNA). In certain embodiments, antisense activity includes modulation of the splicing of pre-mRNA.

As used herein, "RNase H based antisense compound" means an antisense compound wherein at least some of the antisense activity of the antisense compound is attributable to hybridization of the antisense compound to a target nucleic acid and subsequent cleavage of the target nucleic acid by RNase H.

As used herein, "RISC based antisense compound" means an antisense compound wherein at least some of the antisense activity of the antisense compound is attributable to the RNA Induced Silencing Complex (RISC).

As used herein, "detecting" or "measuring" means that a test or assay for detecting or measuring is performed. Such detection and/or measuring may result in a value of zero. Thus, if a test for detection or measuring results in a finding of no activity (activity of zero), the step of detecting or measuring the activity has nevertheless been performed.

As used herein, "detectable and/or measurable activity" means a statistically significant activity that is not zero.

As used herein, "essentially unchanged" means little or no change in a particular parameter, particularly relative to another parameter which changes much more. In certain embodiments, a parameter is essentially unchanged when it changes less than 5%. In certain embodiments, a parameter is essentially unchanged if it changes less than two-fold while another parameter changes at least ten-fold. For example, in certain embodiments, an antisense activity is a change in the amount of a target nucleic acid. In certain such embodiments, the amount of a non-target nucleic acid is essentially unchanged if it changes much less than the target nucleic acid does, but the change need not be zero.

As used herein, "expression" means the process by which a gene ultimately results in a protein. Expression includes, but is not limited to, transcription, post-transcriptional modification (e.g., splicing, polyadenlyation, addition of 5'-cap), and translation.

As used herein, "target nucleic acid" means a nucleic acid molecule to which an antisense compound is intended to hybridize to result in a desired antisense activity. Antisense oligonucleotides have sufficient complementarity to their target nucleic acids to allow hybridization under physiological conditions.

As used herein, "nucleobase complementarity" or "complementarity" when in reference to nucleobases means a nucleobase that is capable of base pairing with another nucleobase. For example, in DNA, adenine (A) is complementary to thymine (T). For example, in RNA, adenine (A) is complementary to uracil (U). In certain embodiments, complementary nucleobase means a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair. Nucleobases comprising certain modifications may maintain the ability to pair with a counterpart nucleobase and thus, are still capable of nucleobase complementarity.

As used herein, "non-complementary" in reference to nucleobases means a pair of nucleobases that do not form hydrogen bonds with one another.

As used herein, "complementary" in reference to oligomeric compounds (e.g., linked nucleosides, oligonucleotides, or nucleic acids) means the capacity of such oligomeric compounds or regions thereof to hybridize to another oligomeric compound or region thereof through nucleobase complementarity. Complementary oligomeric compounds need not have nucleobase complementarity at each nucleoside. Rather, some mismatches are tolerated. In certain embodiments, complementary oligomeric compounds or regions are complementary at 70% of the nucleobases (70% complementary). In certain embodiments, complementary oligomeric compounds or regions are 80% complementary. In certain embodiments, complementary oligomeric compounds or regions are 90% complementary. In certain embodiments, complementary oligomeric compounds or regions are 95% complementary. In certain embodiments, complementary oligomeric compounds or regions are 100% complementary.

As used herein, "mismatch" means a nucleobase of a first oligomeric compound that is not capable of pairing with a nucleobase at a corresponding position of a second oligomeric compound, when the first and second oligomeric compound are aligned. Either or both of the first and second oligomeric compounds may be oligonucleotides.

As used herein, "hybridization" means the pairing of complementary oligomeric compounds (e.g., an antisense compound and its target nucleic acid). While not limited to a particular mechanism, the most common mechanism of pairing involves hydrogen bonding, which may be Watson-Crick, Hoogsteen or reversed Hoogsteen hydrogen bonding, between complementary nucleobases.

As used herein, "specifically hybridizes" means the ability of an oligomeric compound to hybridize to one nucleic acid site with greater affinity than it hybridizes to another nucleic acid site.

As used herein, "fully complementary" in reference to an oligonucleotide or portion thereof means that each nucleobase of the oligonucleotide or portion thereof is capable of pairing with a nucleobase of a complementary nucleic acid or contiguous portion thereof. Thus, a fully complementary region comprises no mismatches or unhybridized nucleobases in either strand.

As used herein, "percent complementarity" means the percentage of nucleobases of an oligomeric compound that are complementary to an equal-length portion of a target nucleic acid. Percent complementarity is calculated by dividing the number of nucleobases of the oligomeric compound that are complementary to nucleobases at corresponding positions in the target nucleic acid by the total length of the oligomeric compound.

As used herein, "percent identity" means the number of nucleobases in a first nucleic acid that are the same type (independent of chemical modification) as nucleobases at corresponding positions in a second nucleic acid, divided by the total number of nucleobases in the first nucleic acid.

As used herein, "modulation" means a change of amount or quality of a molecule, function, or activity when compared to the amount or quality of a molecule, function, or activity prior to modulation. For example, modulation includes the change, either an increase (stimulation or induction) or a decrease (inhibition or reduction) in gene expression. As a further example, modulation of expression can include a change in splice site selection of pre-mRNA processing, resulting in a change in the absolute or relative amount of a particular splice-variant compared to the amount in the absence of modulation.

As used herein, "chemical motif" means a pattern of chemical modifications in an oligonucleotide or a region thereof. Motifs may be defined by modifications at certain nucleosides and/or at certain linking groups of an oligonucleotide.

As used herein, "nucleoside motif" means a pattern of nucleoside modifications in an oligonucleotide or a region thereof. The linkages of such an oligonucleotide may be modified or unmodified. Unless otherwise indicated, motifs herein describing only nucleosides are intended to be nucleoside motifs. Thus, in such instances, the linkages are not limited.

As used herein, "sugar motif" means a pattern of sugar modifications in an oligonucleotide or a region thereof.

As used herein, "linkage motif" means a pattern of linkage modifications in an oligonucleotide or region thereof. The nucleosides of such an oligonucleotide may be modified or unmodified. Unless otherwise indicated, motifs herein describing only linkages are intended to be linkage motifs. Thus, in such instances, the nucleosides are not limited.

As used herein, "nucleobase modification motif" means a pattern of modifications to nucleobases along an oligonucleotide. Unless otherwise indicated, a nucleobase modification motif is independent of the nucleobase sequence.

As used herein, "sequence motif" means a pattern of nucleobases arranged along an oligonucleotide or portion thereof. Unless otherwise indicated, a sequence motif is independent of chemical modifications and thus may have any combination of chemical modifications, including no chemical modifications.

As used herein, "type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

As used herein, "differently modified" mean chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

As used herein, "the same type of modifications" refers to modifications that are the same as one another, including absence of modifications. Thus, for example, two unmodified DNA nucleosides have "the same type of modification," even though the DNA nucleoside is unmodified. Such nucleosides having the same type modification may comprise different nucleobases.

As used herein, "separate regions" means portions of an oligonucleotide wherein the chemical modifications or the motif of chemical modifications of any neighboring portions include at least one difference to allow the separate regions to be distinguished from one another.

As used herein, "pharmaceutically acceptable carrier or diluent" means any substance suitable for use in administering to an animal. In certain embodiments, a pharmaceutically acceptable carrier or diluent is sterile saline. In certain embodiments, such sterile saline is pharmaceutical grade saline.

As used herein the term "metabolic disorder" means a disease or condition principally characterized by dysregulation of metabolism—the complex set of chemical reactions associated with breakdown of food to produce energy.

As used herein, the term "cardiovascular disorder" means a disease or condition principally characterized by impaired function of the heart or blood vessels.

As used herein the term "mono or polycyclic ring system" is meant to include all ring systems selected from single or polycyclic radical ring systems wherein the rings are fused or linked and is meant to be inclusive of single and mixed ring systems individually selected from aliphatic, alicyclic, aryl, heteroaryl, aralkyl, arylalkyl, heterocyclic, heteroaryl, heteroaromatic and heteroarylalkyl. Such mono and poly cyclic structures can contain rings that each have the same level of saturation or each, independently, have varying degrees of saturation including fully saturated, partially saturated or fully unsaturated. Each ring can comprise ring atoms selected from C, N, O and S to give rise to heterocyclic rings as well as rings comprising only C ring atoms which can be present in a mixed motif such as for example benzimidazole wherein one ring has only carbon ring atoms and the fused ring has two nitrogen atoms. The mono or polycyclic ring system can be further substituted with substituent groups such as for example phthalimide which has two =O groups attached to one of the rings. Mono or polycyclic ring systems can be attached to parent molecules using various strategies such as directly through a ring atom, fused through multiple ring atoms, through a substituent group or through a bifunctional linking moiety.

As used herein, "prodrug" means an inactive or less active form of a compound which, when administered to a subject, is metabolized to form the active, or more active, compound (e.g., drug).

As used herein, "substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substituent is any atom or group at the 2'-position of a nucleoside other than H or OH). Substituent groups can be protected or unprotected. In certain embodiments, compounds of the present disclosure have substituents at one or at more than one position of the parent compound. Substituents may also be further substituted with other substituent groups and may be attached directly or via a linking group such as an alkyl or hydrocarbyl group to a parent compound.

Likewise, as used herein, "substituent" in reference to a chemical functional group means an atom or group of atoms that differs from the atom or a group of atoms normally present in the named functional group. In certain embodiments, a substituent replaces a hydrogen atom of the functional group (e.g., in certain embodiments, the substituent of a substituted methyl group is an atom or group other than hydrogen which replaces one of the hydrogen atoms of an unsubstituted methyl group). Unless otherwise indicated, groups amenable for use as substituents include without limitation, halogen, hydroxyl, alkyl, alkenyl, alkynyl, acyl (—C(O)$R_{aa}$), carboxyl (—C(O)O—$R_{aa}$), aliphatic groups, alicyclic groups, alkoxy, substituted oxy (—O—$R_{aa}$), aryl, aralkyl, heterocyclic radical, heteroaryl, heteroarylalkyl, amino (—N($R_{bb}$)($R_{cc}$)), imino(=$NR_{bb}$), amido (—C(O)N($R_{bb}$)($R_{cc}$) or —N($R_{bb}$)C(O)$R_{aa}$), azido (—$N_3$), nitro (—$NO_2$), cyano (—CN), carbamido (—OC(O)N($R_{bb}$)($R_{cc}$) or —N($R_{bb}$)C(O)O$R_{aa}$), ureido (—N($R_{bb}$)C(O)N($R_{bb}$)($R_{cc}$)), thioureido (—N($R_{bb}$)C(S)N($R_{bb}$)—($R_{cc}$)), guanidinyl (—N($R_{bb}$)C(=$NR_{bb}$)N($R_{bb}$)($R_{cc}$)), amidinyl (—C(=$NR_{bb}$)N($R_{bb}$)($R_{cc}$) or —N($R_{bb}$)C(=$NR_{bb}$)($R_{cc}$)), thiol (—$SR_{bb}$), sulfinyl (—S(O)$R_{bb}$), sulfonyl (—S(O)$_2R_{bb}$) and sulfonamidyl (—S(O)$_2$N($R_{bb}$)($R_{cc}$) or —N($R_{bb}$)S—(O)$_2R_{bb}$). Wherein each $R_{aa}$, $R_{bb}$ and $R_{cc}$ is, independently, H, an optionally linked chemical functional group or a further substituent group with a preferred list including without limitation, alkyl, alkenyl, alkynyl, aliphatic, alkoxy, acyl, aryl, aralkyl, heteroaryl, alicyclic, heterocyclic and heteroarylalkyl. Selected substituents within the compounds described herein are present to a recursive degree.

As used herein, "alkyl," as used herein, means a saturated straight or branched hydrocarbon radical containing up to twenty four carbon atoms. Examples of alkyl groups include without limitation, methyl, ethyl, propyl, butyl, isopropyl, n-hexyl, octyl, decyl, dodecyl and the like. Alkyl groups typically include from 1 to about 24 carbon atoms, more typically from 1 to about 12 carbon atoms ($C_1$-$C_{12}$ alkyl) with from 1 to about 6 carbon atoms being more preferred.

As used herein, "alkenyl," means a straight or branched hydrocarbon chain radical containing up to twenty four carbon atoms and having at least one carbon-carbon double bond. Examples of alkenyl groups include without limitation, ethenyl, propenyl, butenyl, 1-methyl-2-buten-1-yl, dienes such as 1,3-butadiene and the like. Alkenyl groups typically include from 2 to about 24 carbon atoms, more typically from 2 to about 12 carbon atoms with from 2 to about 6 carbon atoms being more preferred. Alkenyl groups as used herein may optionally include one or more further substituent groups.

As used herein, "alkynyl," means a straight or branched hydrocarbon radical containing up to twenty four carbon atoms and having at least one carbon-carbon triple bond. Examples of alkynyl groups include, without limitation, ethynyl, 1-propynyl, 1-butynyl, and the like. Alkynyl groups typically include from 2 to about 24 carbon atoms, more typically from 2 to about 12 carbon atoms with from 2 to about 6 carbon atoms being more preferred. Alkynyl groups as used herein may optionally include one or more further substituent groups.

As used herein, "acyl," means a radical formed by removal of a hydroxyl group from an organic acid and has the general Formula —C(O)—X where X is typically aliphatic, alicyclic or aromatic. Examples include aliphatic carbonyls, aromatic carbonyls, aliphatic sulfonyls, aromatic sulfinyls, aliphatic sulfinyls, aromatic phosphates, aliphatic phosphates and the like. Acyl groups as used herein may optionally include further substituent groups.

As used herein, "alicyclic" means a cyclic ring system wherein the ring is aliphatic. The ring system can comprise one or more rings wherein at least one ring is aliphatic. Preferred alicyclics include rings having from about 5 to about 9 carbon atoms in the ring. Alicyclic as used herein may optionally include further substituent groups.

As used herein, "aliphatic" means a straight or branched hydrocarbon radical containing up to twenty four carbon atoms wherein the saturation between any two carbon atoms is a single, double or triple bond. An aliphatic group preferably contains from 1 to about 24 carbon atoms, more typically from 1 to about 12 carbon atoms with from 1 to about 6 carbon atoms being more preferred. The straight or branched chain of an aliphatic group may be interrupted with one or more heteroatoms that include nitrogen, oxygen, sulfur and phosphorus. Such aliphatic groups interrupted by heteroatoms include without limitation, polyalkoxys, such as polyalkylene glycols, polyamines, and polyimines Aliphatic groups as used herein may optionally include further substituent groups.

As used herein, "alkoxy" means a radical formed between an alkyl group and an oxygen atom wherein the oxygen atom is used to attach the alkoxy group to a parent molecule. Examples of alkoxy groups include without limitation, methoxy, ethoxy, propoxy, isopropoxy, n-butoxy, sec-butoxy, tert-butoxy, n-pentoxy, neopentoxy, n-hexoxy and the like. Alkoxy groups as used herein may optionally include further substituent groups.

As used herein, "aminoalkyl" means an amino substituted $C_1$-$C_{12}$ alkyl radical. The alkyl portion of the radical forms a covalent bond with a parent molecule. The amino group can be located at any position and the aminoalkyl group can be substituted with a further substituent group at the alkyl and/or amino portions.

As used herein, "aralkyl" and "arylalkyl" mean an aromatic group that is covalently linked to a $C_1$-$C_{12}$ alkyl radical. The alkyl radical portion of the resulting aralkyl (or arylalkyl) group forms a covalent bond with a parent molecule. Examples include without limitation, benzyl, phenethyl and the like. Aralkyl groups as used herein may optionally include further substituent groups attached to the alkyl, the aryl or both groups that form the radical group.

As used herein, "aryl" and "aromatic" mean a mono- or polycyclic carbocyclic ring system radicals having one or more aromatic rings. Examples of aryl groups include without limitation, phenyl, naphthyl, tetrahydronaphthyl, indanyl, idenyl and the like. Preferred aryl ring systems have from about 5 to about 20 carbon atoms in one or more rings. Aryl groups as used herein may optionally include further substituent groups.

As used herein, "halo" and "halogen," mean an atom selected from fluorine, chlorine, bromine and iodine.

As used herein, "heteroaryl," and "heteroaromatic," mean a radical comprising a mono- or polycyclic aromatic ring, ring system or fused ring system wherein at least one of the rings is aromatic and includes one or more heteroatoms. Heteroaryl is also meant to include fused ring systems including systems where one or more of the fused rings contain no heteroatoms. Heteroaryl groups typically include one ring atom selected from sulfur, nitrogen or oxygen. Examples of heteroaryl groups include without limitation, pyridinyl, pyrazinyl, pyrimidinyl, pyrrolyl, pyrazolyl, imidazolyl, thiazolyl, oxazolyl, isooxazolyl, thiadiazolyl, oxadiazolyl, thiophenyl, furanyl, quinolinyl, isoquinolinyl, benzimidazolyl, benzooxazolyl, quinoxalinyl and the like. Heteroaryl radicals can be attached to a parent molecule directly or through a linking moiety such as an aliphatic group or hetero atom. Heteroaryl groups as used herein may optionally include further substituent groups.

As used herein, "conjugate compound" means any atoms, group of atoms, or group of linked atoms suitable for use as a conjugate group. In certain embodiments, conjugate compounds may possess or impart one or more properties, including, but not limited to pharmacodynamic, pharmacokinetic, binding, absorption, cellular distribution, cellular uptake, charge and/or clearance properties.

As used herein, unless otherwise indicated or modified, the term "double-stranded" refers to two separate oligomeric compounds that are hybridized to one another. Such double stranded compounds may have one or more or non-hybridizing nucleosides at one or both ends of one or both strands (overhangs) and/or one or more internal non-hybridizing nucleosides (mismatches) provided there is sufficient complementarity to maintain hybridization under physiologically relevant conditions.

B. Certain Compounds

In certain embodiments, the invention provides conjugated antisense compounds comprising antisense oligonucleotides and a conjugate.

a. Certain Antisense Oligonucleotides

In certain embodiments, the invention provides antisense oligonucleotides. Such antisense oligonucleotides comprise linked nucleosides, each nucleoside comprising a sugar moiety and a nucleobase. The structure of such antisense oligonucleotides may be considered in terms of chemical features (e.g., modifications and patterns of modifications) and nucleobase sequence (e.g., sequence of antisense oligonucleotide, identity and sequence of target nucleic acid).

i. Certain Chemistry Features

In certain embodiments, antisense oligonucleotide comprise one or more modification. In certain such embodiments, antisense oligonucleotides comprise one or more modified nucleosides and/or modified internucleoside linkages. In certain embodiments, modified nucleosides comprise a modified sugar moiety and/or modified nucleobase.

1. Certain Sugar Moieties

In certain embodiments, compounds of the disclosure comprise one or more modified nucleosides comprising a modified sugar moiety. Such compounds comprising one or more sugar-modified nucleosides may have desirable properties, such as enhanced nuclease stability or increased binding affinity with a target nucleic acid relative to an oligonucleotide comprising only nucleosides comprising naturally occurring sugar moieties. In certain embodiments, modified sugar moieties are substituted sugar moieties. In certain embodiments, modified sugar moieties are sugar surrogates. Such sugar surrogates may comprise one or more substitutions corresponding to those of substituted sugar moieties.

In certain embodiments, modified sugar moieties are substituted sugar moieties comprising one or more non-bridging sugar substituent, including but not limited to substituents at the 2' and/or 5' positions. Examples of sugar substituents suitable for the 2'-position, include, but are not limited to: 2'-F, 2'-OCH$_3$ ("OMe" or "O-methyl"), and 2'-O(CH$_2$)$_2$OCH$_3$ ("MOE"). In certain embodiments, sugar substituents at the 2' position is selected from allyl, amino, azido, thio, O-allyl, O—C$_1$-C$_{10}$ alkyl, O—C$_1$-C$_{10}$ substituted alkyl; OCF$_3$, O(CH$_2$)$_2$SCH$_3$, O(CH$_2$)$_2$—O—N(Rm)(Rn), and O—CH$_2$—C(=O)—N(Rm)(Rn), where each Rm and Rn is, independently, H or substituted or unsubstituted C$_1$-C$_{10}$ alkyl. Examples of sugar substituents at the 5'-position, include, but are not limited to: 5'-methyl (R or S); 5'-vinyl, and 5'-methoxy. In certain embodiments, substituted sugars comprise more than one non-bridging sugar substituent, for example, 2'-F-5'-methyl sugar moieties (see, e.g., PCT International Application WO 2008/101157, for additional 5',2'-bis substituted sugar moieties and nucleosides).

Nucleosides comprising 2'-substituted sugar moieties are referred to as 2'-substituted nucleosides. In certain embodiments, a 2'-substituted nucleoside comprises a 2'-substituent group selected from halo, allyl, amino, azido, SH, CN, OCN, CF$_3$, OCF$_3$, O, S, or N(R$_m$)-alkyl; O, S, or N(R$_m$)-alkenyl; O, S or N(R$_m$)-alkynyl; O-alkylenyl-O-alkyl, alkynyl, alkaryl, aralkyl, O-alkaryl, O-aralkyl, O(CH$_2$)$_2$SCH$_3$, O—(CH$_2$)$_2$—O—N(R$_m$)(R$_n$) or O—CH$_2$—C(=O)—N(R$_m$)(R$_n$), where each R$_m$ and R$_n$ is, independently, H, an amino protecting group or substituted or unsubstituted C$_1$-C$_{10}$ alkyl. These 2'-substituent groups can be further substituted with one or more substituent groups independently selected from hydroxyl, amino, alkoxy, carboxy, benzyl, phenyl, nitro (NO$_2$), thiol, thioalkoxy (S-alkyl), halogen, alkyl, aryl, alkenyl and alkynyl.

In certain embodiments, a 2'-substituted nucleoside comprises a 2'-substituent group selected from F, NH$_2$, N$_3$, OCF$_3$, O—CH$_3$, O(CH$_2$)$_3$NH$_2$, CH$_2$—CH=CH$_2$, O—CH$_2$—CH=CH$_2$, OCH$_2$CH$_2$OCH$_3$, O(CH$_2$)$_2$SCH$_3$, O—(CH$_2$)$_2$—O—N(R$_m$)(R$_n$), O(CH$_2$)$_2$—O—(CH$_2$)$_2$N(CH$_3$)$_2$, and N-substituted acetamide (O—CH$_2$—C(=O)—N(R$_m$)(R$_n$) where each R$_m$ and R$_n$ is, independently, H, an amino protecting group or substituted or unsubstituted C$_1$-C$_{10}$ alkyl.

In certain embodiments, a 2'-substituted nucleoside comprises a sugar moiety comprising a 2'-substituent group selected from F, OCF$_3$, O—CH$_3$, OCH$_2$CH$_2$OCH$_3$, O(CH$_2$)$_2$SCH$_3$, O—(CH$_2$)$_2$—O—N(CH$_3$)$_2$, —O(CH$_2$)$_2$—O—(CH$_2$)$_2$N(CH$_3$)$_2$, and O—CH$_2$—C(=O)—N(H)CH$_3$.

In certain embodiments, a 2'-substituted nucleoside comprises a sugar moiety comprising a 2'-substituent group selected from F, O—CH$_3$, and OCH$_2$CH$_2$OCH$_3$.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' sugar substituents, include, but are not limited to: —[C(R$_a$)(R$_b$)]$_n$—, —[C(R$_a$)(R$_b$)]$_n$—O—, —C(R$_a$R$_b$)—N(R)—O— or, —C(R$_a$R$_b$)—O—N(R)—; 4'-CH$_2$-2',4'-(CH$_2$)$_2$-2',4'-(CH$_2$)$_3$-2',4'-(CH$_2$)—O-2' (LNA); 4'-(CH$_2$)—S-2; 4'-(CH$_2$)$_2$—O-2' (ENA); 4'-CH(CH$_3$)—O-2' (cEt) and 4'-CH(CH$_2$OCH$_3$)—O-2', and analogs thereof (see, e.g., U.S. Pat. No. 7,399,845, issued on Jul. 15, 2008); 4'-C(CH$_3$)(CH$_3$)—O-2' and analogs thereof, (see, e.g., WO2009/006478, published Jan. 8, 2009); 4'-CH$_2$—N(OCH$_3$)-2' and analogs thereof (see, e.g., WO2008/150729, published Dec. 11, 2008); 4'-CH$_2$-β-N(CH$_3$)-2' (see, e.g., US2004/0171570, published Sep. 2, 2004); 4'-CH$_2$—O—N(R)-2', and 4'-CH$_2$—N(R)—O-2'-, wherein each R is, independently, H, a protecting group, or C$_1$-C$_{12}$ alkyl; 4'-CH$_2$—N(R)—O-2', wherein R is H, C$_1$-C$_{12}$ alkyl, or a protecting group (see, U.S. Pat. No. 7,427,672, issued on Sep. 23, 2008); 4'-CH$_2$—C(H)(CH$_3$)-2' (see, e.g., Chattopadhyaya, et al., *J. Org. Chem.*, 2009, 74, 118-134); and 4'-CH$_2$—C(=CH$_2$)-2' and analogs thereof (see, published PCT International Application WO 2008/154401, published on Dec. 8, 2008).

In certain embodiments, such 4' to 2' bridges independently comprise from 1 to 4 linked groups independently selected from —[C(R$_a$)(R$_b$)]$_n$—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:
x is 0, 1, or 2;
n is 1, 2, 3, or 4;
each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Nucleosides comprising bicyclic sugar moieties are referred to as bicyclic nucleosides or BNAs. Bicyclic nucleosides include, but are not limited to, (A) α-L-Methyleneoxy (4'-CH$_2$—O-2') BNA, (B) β-D-Methyleneoxy (4'-CH$_2$—O-2') BNA (also referred to as locked nucleic acid or LNA), (C) Ethyleneoxy (4'-(CH$_2$)$_2$—O-2') BNA, (D) Aminooxy (4'-CH$_2$—O—N(R)-2') BNA, (E) Oxyamino (4'-CH$_2$—N(R)—O-2') BNA, (F) Methyl(methyleneoxy) (4'-CH(CH$_3$)—O-2') BNA (also referred to as constrained ethyl or cEt), (G) methylene-thio (4'-CH$_2$—S-2') BNA, (H) methylene-amino (4'-CH$_2$—N(R)-2') BNA, (I) methyl carbocyclic (4'-CH$_2$—CH(CH$_3$)-2') BNA, and (J) propylene carbocyclic (4'-(CH$_2$)$_3$-2') BNA as depicted below.

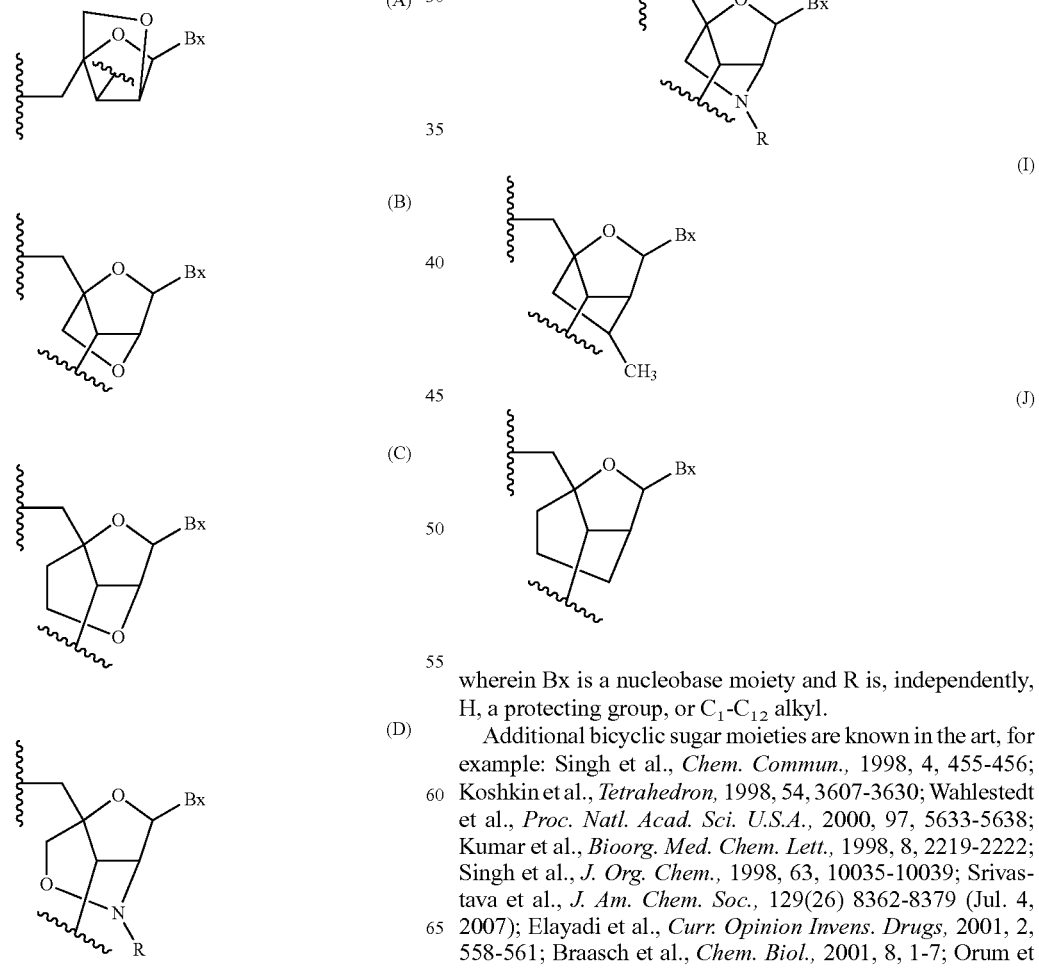

wherein Bx is a nucleobase moiety and R is, independently, H, a protecting group, or $C_1$-$C_{12}$ alkyl.

Additional bicyclic sugar moieties are known in the art, for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 129(26) 8362-8379 (Jul. 4, 2007); Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; U.S. Pat. Nos.

7,053,207, 6,268,490, 6,770,748, 6,794,499, 7,034,133, 6,525,191, 6,670,461, and 7,399,845; WO 2004/106356, WO 1994/14226, WO 2005/021570, and WO 2007/134181; U.S. Patent Publication Nos. US2004/0171570, US2007/0287831, and US2008/0039618; U.S. patent Ser. No. 12/129,154, 60/989,574, 61/026,995, 61/026,998, 61/056,564, 61/086,231, 61/097,787, and 61/099,844; and PCT International Applications Nos. PCT/US2008/064591, PCT/US2008/066154, and PCT/US2008/068922.

In certain embodiments, bicyclic sugar moieties and nucleosides incorporating such bicyclic sugar moieties are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') bicyclic nucleosides have been incorporated into antisense oligonucleotides that showed antisense activity (Frieden et al., *Nucleic Acids Research*, 2003, 21, 6365-6372).

In certain embodiments, substituted sugar moieties comprise one or more non-bridging sugar substituent and one or more bridging sugar substituent (e.g., 5'-substituted and 4'-2' bridged sugars). (see, PCT International Application WO 2007/134181, published on Nov. 22, 2007, wherein LNA is substituted with, for example, a 5'-methyl or a 5'-vinyl group).

In certain embodiments, modified sugar moieties are sugar surrogates. In certain such embodiments, the oxygen atom of the naturally occurring sugar is substituted, e.g., with a sulfer, carbon or nitrogen atom. In certain such embodiments, such modified sugar moiety also comprises bridging and/or non-bridging substituents as described above. For example, certain sugar surrogates comprise a 4'-sulfer atom and a substitution at the 2'-position (see, e.g., published U.S. Patent Application US2005/0130923, published on Jun. 16, 2005) and/or the 5' position. By way of additional example, carbocyclic bicyclic nucleosides having a 4'-2' bridge have been described (see, e.g., Freier et al., *Nucleic Acids Research*, 1997, 25(22), 4429-4443 and Albaek et al., *J. Org. Chem.*, 2006, 71, 7731-7740).

In certain embodiments, sugar surrogates comprise rings having other than 5-atoms. For example, in certain embodiments, a sugar surrogate comprises a morphlino. Morpholino compounds and their use in oligomeric compounds has been reported in numerous patents and published articles (see for example: Braasch et al., *Biochemistry*, 2002, 41, 4503-4510; and U.S. Pat. Nos. 5,698,685; 5,166,315; 5,185,444; and 5,034,506). As used here, the term "morpholino" means a sugar surrogate having the following structure:

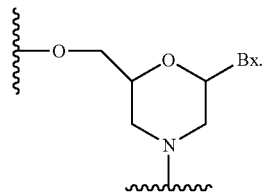

In certain embodiments, morpholinos may be modified, for example by adding or altering various substituent groups from the above morpholino structure. Such sugar surrogates are referred to herein as "modified morpholinos."

For another example, in certain embodiments, a sugar surrogate comprises a six-membered tetrahydropyran. Such tetrahydropyrans may be further modified or substituted. Nucleosides comprising such modified tetrahydropyrans include, but are not limited to, hexitol nucleic acid (HNA), anitol nucleic acid (ANA), manitol nucleic acid (MNA) (see Leumann, C J. *Bioorg. & Med. Chem.* (2002) 10:841-854), fluoro HNA (F-HNA), and those compounds having Formula VI:

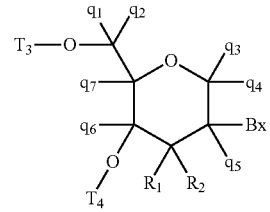

VI wherein independently for each of said at least one tetrahydropyran nucleoside analog of Formula VI:

Bx is a nucleobase moiety;

$T_3$ and $T_4$ are each, independently, an internucleoside linking group linking the tetrahydropyran nucleoside analog to the antisense compound or one of $T_3$ and $T_4$ is an internucleoside linking group linking the tetrahydropyran nucleoside analog to the antisense compound and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, the modified THP nucleosides of Formula VI are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VI are provided wherein one of $R_1$ and $R_2$ is F. In certain embodiments, $R_1$ is fluoro and $R_2$ is H, $R_1$ is methoxy and $R_2$ is H, and $R_1$ is methoxyethoxy and $R_2$ is H.

Many other bicyclo and tricyclo sugar surrogate ring systems are also known in the art that can be used to modify nucleosides for incorporation into antisense compounds (see, e.g., review article: Leumann, J. C, *Bioorganic & Medicinal Chemistry*, 2002, 10, 841-854).

Combinations of modifications are also provided without limitation, such as 2'-F-5'-methyl substituted nucleosides (see PCT International Application WO 2008/101157 Published on Aug. 21, 2008 for other disclosed 5',2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-CH$_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

In certain embodiments, the present disclosure provides oligonucleotides comprising modified nucleosides. Those modified nucleotides may include modified sugars, modified nucleobases, and/or modified linkages. The specific modifications are selected such that the resulting oligonucleotides possess desirable characteristics. In certain embodiments, oligonucleotides comprise one or more RNA-like nucleosides. In certain embodiments, oligonucleotides comprise one or more DNA-like nucleotides.

2. Certain Nucleobase Modifications

In certain embodiments, nucleosides of the present disclosure comprise one or more unmodified nucleobases. In certain embodiments, nucleosides of the present disclosure comprise one or more modified nucleobases.

In certain embodiments, modified nucleobases are selected from: universal bases, hydrophobic bases, promiscuous bases, size-expanded bases, and fluorinated bases as defined herein. 5-substituted pyrimidines, 6-azapyrimidines and N-2, N-6 and O-6 substituted purines, including 2-aminopropyladenine, 5-propynyluracil; 5-propynylcytosine; 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl ($-C\equiv C-CH_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine, 3-deazaguanine and 3-deazaadenine, universal bases, hydrophobic bases, promiscuous bases, size-expanded bases, and fluorinated bases as defined herein. Further modified nucleobases include tricyclic pyrimidines such as phenoxazine cytidine ([5,4-b][1,4]benzoxazin-2(3H)-one), phenothiazine cytidine (1H-pyrimido[5,4-b][1,4]benzothiazin-2(3H)-one), G-clamps such as a substituted phenoxazine cytidine (e.g. 9-(2-aminoethoxy)-H-pyrimido[5,4-b][1,4]benzoxazin-2 (3H)-one), carbazole cytidine (2H-pyrimido[4,5-b]indol-2-one), pyridoindole cytidine (H-pyrido[3',2':4,5]pyrrolo[2,3-d]pyrimidin-2-one). Modified nucleobases may also include those in which the purine or pyrimidine base is replaced with other heterocycles, for example 7-deaza-adenine, 7-deaza-guanosine, 2-aminopyridine and 2-pyridone. Further nucleobases include those disclosed in U.S. Pat. No. 3,687,808, those disclosed in *The Concise Encyclopedia Of Polymer Science And Engineering*, Kroschwitz, J. I., Ed., John Wiley & Sons, 1990, 858-859; those disclosed by Englisch et al., *Angewandte Chemie*, International Edition, 1991, 30, 613; and those disclosed by Sanghvi, Y. S., Chapter 15, *Antisense Research and Applications*, Crooke, S. T. and Lebleu, B., Eds., CRC Press, 1993, 273-288.

Representative United States patents that teach the preparation of certain of the above noted modified nucleobases as well as other modified nucleobases include without limitation, U.S. Pat. Nos. 3,687,808; 4,845,205; 5,130,302; 5,134, 066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,645,985; 5,681,941; 5,750,692; 5,763,588; 5,830,653 and 6,005,096, certain of which are commonly owned with the instant application, and each of which is herein incorporated by reference in its entirety.

3. Certain Internucleoside Linkages

In certain embodiments, the present disclosure provides oligonucleotides comprising linked nucleosides. In such embodiments, nucleosides may be linked together using any internucleoside linkage. The two main classes of internucleoside linking groups are defined by the presence or absence of a phosphorus atom. Representative phosphorus containing internucleoside linkages include, but are not limited to, phosphodiesters (PO), phosphotriesters, methylphosphonates, phosphoramidate, and phosphorothioates (PS). Representative non-phosphorus containing internucleoside linking groups include, but are not limited to, methylenemethylimino ($-CH_2-N(CH_3)-O-CH_2-$), thiodiester ($-O-C(O)-S-$), thionocarbamate ($-O-C(O)(NH)-S-$); siloxane ($-O-Si(H)_2-O-$); and N,N'-dimethylhydrazine ($-CH_2-N(CH_3)-N(CH_3)-$). Modified linkages, compared to natural phosphodiester linkages, can be used to alter, typically increase, nuclease resistance of the oligonucleotide. In certain embodiments, internucleoside linkages having a chiral atom can be prepared as a racemic mixture, or as separate enantiomers. Representative chiral linkages include, but are not limited to, alkylphosphonates and phosphorothioates. Methods of preparation of phosphorous-containing and non-phosphorous-containing internucleoside linkages are well known to those skilled in the art.

The oligonucleotides described herein contain one or more asymmetric centers and thus give rise to enantiomers, diastereomers, and other stereoisomeric configurations that may be defined, in terms of absolute stereochemistry, as (R) or (S), α or β such as for sugar anomers, or as (D) or (L) such as for amino acids etc. Included in the antisense compounds provided herein are all such possible isomers, as well as their racemic and optically pure forms.

Neutral internucleoside linkages include without limitation, phosphotriesters, methylphosphonates, MMI (3'-$CH_2$—N($CH_3$)—O-5'), amide-3 (3'-$CH_2$—C(=O)—N(H)-5'), amide-4 (3'-$CH_2$—N(H)—C(=O)-5'), formacetal (3'-O—$CH_2$—O-5'), and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

4. Certain Motifs

In certain embodiments, antisense oligonucleotides comprise one or more modified nucleoside (e.g., nucleoside comprising a modified sugar and/or modified nucleobase) and/or one or more modified internucleoside linkage. The pattern of such modifications on an oligonucleotide is referred to herein as a motif. In certain embodiments, sugar, nucleobase, and linkage motifs are independent of one another.

a. Certain Sugar Motifs

In certain embodiments, oligonucleotides comprise one or more type of modified sugar moieties and/or naturally occurring sugar moieties arranged along an oligonucleotide or region thereof in a defined pattern or sugar modification motif. Such motifs may include any of the sugar modifications discussed herein and/or other known sugar modifications.

In certain embodiments, the oligonucleotides comprise or consist of a region having a gapmer sugar motif, which comprises two external regions or "wings" and a central or internal region or "gap." The three regions of a gapmer sugar motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap. In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric sugar gapmer). In certain embodiments, the sugar motifs of the 5'-wing differs from the sugar motif of the 3'-wing (asymmetric sugar gapmer).

i. Certain 5'-Wings

In certain embodiments, the 5'-wing of a gapmer consists of 1 to 8 linked nucleosides. In certain embodiments, the 5'-wing of a gapmer consists of 1 to 7 linked nucleosides. In certain embodiments, the 5'-wing of a gapmer consists of 1 to 6 linked nucleosides. In certain embodiments, the 5'-wing of a gapmer consists of 1 to 5 linked nucleosides. In certain embodiments, the 5'-wing of a gapmer consists of 2 to 5 linked nucleosides. In certain embodiments, the 5'-wing of a gapmer consists of 3 to 5 linked nucleosides. In certain embodiments, the 5'-wing of a gapmer consists of 4 or 5 linked nucleosides. In certain embodiments, the 5'-wing of a gapmer consists of 1 to 4 linked nucleosides. In certain embodiments, the 5'-wing of a gapmer consists of 1 to 3 linked nucleosides. In certain embodiments, the 5'-wing of a gapmer consists of 1 or 2 linked nucleosides. In certain embodiments, the 5'-wing of a gapmer consists of 2 to 4 linked nucleosides. In certain embodiments, the 5'-wing of a gapmer consists of 2 or 3 linked nucleosides. In certain embodiments, the 5'-wing of a gapmer consists of 3 or 4 linked nucleosides. In certain embodiments, the 5'-wing of a gapmer consists of 1 nucleoside. In certain embodiments, the 5'-wing of a gapmer consists of 2 linked nucleosides. In certain embodiments, the 5'-wing of a gapmer consists of 3 linked nucleosides. In certain embodiments, the 5'-wing of a gapmer consists of 4 linked nucleosides. In certain embodiments, the 5'-wing of a gapmer consists of 5 linked nucleosides. In certain embodiments, the 5'-wing of a gapmer consists of 6 linked nucleosides.

In certain embodiments, the 5'-wing of a gapmer comprises at least one bicyclic nucleoside. In certain embodiments, the 5'-wing of a gapmer comprises at least two bicyclic nucleosides. In certain embodiments, the 5'-wing of a gapmer comprises at least three bicyclic nucleosides. In certain embodiments, the 5'-wing of a gapmer comprises at least four bicyclic nucleosides. In certain embodiments, the 5'-wing of a gapmer comprises at least one constrained ethyl nucleoside. In certain embodiments, the 5'-wing of a gapmer comprises at least one LNA nucleoside. In certain embodiments, each nucleoside of the 5'-wing of a gapmer is a bicyclic nucleoside. In certain embodiments, each nucleoside of the 5'-wing of a gapmer is a constrained ethyl nucleoside. In certain embodiments, each nucleoside of the 5'-wing of a gapmer is a LNA nucleoside.

In certain embodiments, the 5'-wing of a gapmer comprises at least one non-bicyclic modified nucleoside. In certain embodiments, the 5'-wing of a gapmer comprises at least one 2'-substituted nucleoside. In certain embodiments, the 5'-wing of a gapmer comprises at least one 2'-MOE nucleoside. In certain embodiments, the 5'-wing of a gapmer comprises at least one 2'-OMe nucleoside. In certain embodiments, each nucleoside of the 5'-wing of a gapmer is a non-bicyclic modified nucleoside. In certain embodiments, each nucleoside of the 5'-wing of a gapmer is a 2'-substituted nucleoside. In certain embodiments, each nucleoside of the 5'-wing of a gapmer is a 2'-MOE nucleoside. In certain embodiments, each nucleoside of the 5'-wing of a gapmer is a 2'-OMe nucleoside.

In certain embodiments, the 5'-wing of a gapmer comprises at least one 2'-deoxynucleoside. In certain embodiments, each nucleoside of the 5'-wing of a gapmer is a 2'-deoxynucleoside. In a certain embodiments, the 5'-wing of a gapmer comprises at least one ribonucleoside. In certain embodiments, each nucleoside of the 5'-wing of a gapmer is a ribonucleoside. In certain embodiments, one, more than one, or each of the nucleosides of the 5'-wing is an RNA-like nucleoside.

In certain embodiments, the 5'-wing of a gapmer comprises at least one bicyclic nucleoside and at least one non-bicyclic modified nucleoside. In certain embodiments, the 5'-wing of a gapmer comprises at least one bicyclic nucleoside and at least one 2'-substituted nucleoside. In certain embodiments, the 5'-wing of a gapmer comprises at least one bicyclic nucleoside and at least one 2'-MOE nucleoside. In certain embodiments, the 5'-wing of a gapmer comprises at least one bicyclic nucleoside and at least one 2'-OMe nucleoside. In certain embodiments, the 5'-wing of a gapmer comprises at least one bicyclic nucleoside and at least one 2'-deoxynucleoside.

In certain embodiments, the 5'-wing of a gapmer comprises at least one constrained ethyl nucleoside and at least one non-bicyclic modified nucleoside. In certain embodiments, the 5'-wing of a gapmer comprises at least one constrained ethyl nucleoside and at least one 2'-substituted nucleoside. In certain embodiments, the 5'-wing of a gapmer comprises at least one constrained ethyl nucleoside and at least one 2'-MOE nucleoside. In certain embodiments, the 5'-wing of a gapmer comprises at least one constrained ethyl nucleoside and at least one 2'-OMe nucleoside. In certain embodiments, the 5'-wing of a gapmer comprises at least one constrained ethyl nucleoside and at least one 2'-deoxynucleoside.

ii. Certain 3'-Wings

In certain embodiments, the 3'-wing of a gapmer consists of 1 to 8 linked nucleosides. In certain embodiments, the 3'-wing of a gapmer consists of 1 to 7 linked nucleosides. In certain embodiments, the 3'-wing of a gapmer consists of 1 to 6 linked nucleosides. In certain embodiments, the 3'-wing of a gapmer consists of 1 to 5 linked nucleosides. In certain embodiments, the 3'-wing of a gapmer consists of 2 to 5 linked nucleosides. In certain embodiments, the 3'-wing of a gapmer consists of 3 to 5 linked nucleosides. In certain embodiments, the 3'-wing of a gapmer consists of 4 or 5 linked nucleosides. In certain embodiments, the 3'-wing of a gapmer consists of 1 to 4 linked nucleosides. In certain embodiments, the 3'-wing of a gapmer consists of 1 to 3 linked nucleosides. In certain embodiments, the 3'-wing of a gapmer consists of 1 or 2 linked nucleosides. In certain embodiments, the 3'-wing of a gapmer consists of 2 to 4 linked nucleosides. In certain embodiments, the 3'-wing of a gapmer consists of 2 or 3 linked nucleosides. In certain embodiments, the 3'-wing of a gapmer consists of 3 or 4 linked nucleosides. In certain embodiments, the 3'-wing of a gapmer consists of 1 nucleoside. In certain embodiments, the 3'-wing of a gapmer consists of 2 linked nucleosides. In certain embodiments, the 3'-wing of a gapmer consists of 3 linked nucleosides. In certain embodiments, the 3'-wing of a gapmer consists of 4 linked nucleosides. In certain embodiments, the 3'-wing of a gapmer consists of 5 linked nucleosides. In certain embodiments, the 3'-wing of a gapmer consists of 6 linked nucleosides.

In certain embodiments, the 3'-wing of a gapmer comprises at least one bicyclic nucleoside. In certain embodiments, the 3'-wing of a gapmer comprises at least one constrained ethyl nucleoside. In certain embodiments, the 3'-wing of a gapmer comprises at least one LNA nucleoside. In certain embodiments, each nucleoside of the 3'-wing of a gapmer is a bicyclic nucleoside. In certain embodiments, each nucleoside of the 3'-wing of a gapmer is a constrained ethyl nucleoside. In certain embodiments, each nucleoside of the 3'-wing of a gapmer is a LNA nucleoside.

In certain embodiments, the 3'-wing of a gapmer comprises at least one non-bicyclic modified nucleoside. In certain embodiments, the 3'-wing of a gapmer comprises at least two non-bicyclic modified nucleosides. In certain embodiments, the 3'-wing of a gapmer comprises at least three non-bicyclic modified nucleosides. In certain embodiments, the 3'-wing of a gapmer comprises at least four non-bicyclic modified nucleosides. In certain embodiments, the 3'-wing of a gapmer comprises at least one 2'-substituted nucleoside. In certain embodiments, the 3'-wing of a gapmer comprises at least one 2'-MOE nucleoside. In certain embodiments, the 3'-wing of a gapmer comprises at least one 2'-OMe nucleoside. In certain embodiments, each nucleoside of the 3'-wing of a gapmer is a non-bicyclic modified nucleoside. In certain embodiments, each nucleoside of the 3'-wing of a gapmer is a 2'-substituted nucleoside. In certain embodiments, each nucleoside of the 3'-wing of a gapmer is a 2'-MOE nucleoside. In certain embodiments, each nucleoside of the 3'-wing of a gapmer is a 2'-OMe nucleoside.

In certain embodiments, the 3'-wing of a gapmer comprises at least one 2'-deoxynucleoside. In certain embodiments, each nucleoside of the 3'-wing of a gapmer is a 2'-deoxynucleoside. In a certain embodiments, the 3'-wing of a gapmer comprises at least one ribonucleoside. In certain embodiments, each nucleoside of the 3'-wing of a gapmer is a ribonucleoside. In certain embodiments, one, more than one, or each of the nucleosides of the 5'-wing is an RNA-like nucleoside.

In certain embodiments, the 3'-wing of a gapmer comprises at least one bicyclic nucleoside and at least one non-bicyclic modified nucleoside. In certain embodiments, the 3'-wing of a gapmer comprises at least one bicyclic nucleoside and at least one 2'-substituted nucleoside. In certain embodiments, the 3'-wing of a gapmer comprises at least one bicyclic nucleoside and at least one 2'-MOE nucleoside. In certain embodiments, the 3'-wing of a gapmer comprises at least one bicyclic nucleoside and at least one 2'-OMe nucleoside. In certain embodiments, the 3'-wing of a gapmer comprises at least one bicyclic nucleoside and at least one 2'-deoxynucleoside.

In certain embodiments, the 3'-wing of a gapmer comprises at least one constrained ethyl nucleoside and at least one non-bicyclic modified nucleoside. In certain embodiments, the 3'-wing of a gapmer comprises at least one constrained ethyl nucleoside and at least one 2'-substituted nucleoside. In certain embodiments, the 3'-wing of a gapmer comprises at least one constrained ethyl nucleoside and at least one 2'-MOE nucleoside. In certain embodiments, the 3'-wing of a gapmer comprises at least one constrained ethyl nucleoside and at least one 2'-OMe nucleoside. In certain embodiments, the 3'-wing of a gapmer comprises at least one constrained ethyl nucleoside and at least one 2'-deoxynucleoside.

In certain embodiments, the 3'-wing of a gapmer comprises at least one LNA nucleoside and at least one non-bicyclic modified nucleoside. In certain embodiments, the 3'-wing of a gapmer comprises at least one LNA nucleoside and at least one 2'-substituted nucleoside. In certain embodiments, the 3'-wing of a gapmer comprises at least one LNA nucleoside and at least one 2'-MOE nucleoside. In certain embodiments, the 3'-wing of a gapmer comprises at least one LNA nucleoside and at least one 2'-OMe nucleoside. In certain embodiments, the 3'-wing of a gapmer comprises at least one LNA nucleoside and at least one 2'-deoxynucleoside.

In certain embodiments, the 3'-wing of a gapmer comprises at least one bicyclic nucleoside, at least one non-bicyclic modified nucleoside, and at least one 2'-deoxynucleoside. In certain embodiments, the 3'-wing of a gapmer comprises at least one constrained ethyl nucleoside, at least one non-bicyclic modified nucleoside, and at least one 2'-deoxynucleoside. In certain embodiments, the 3'-wing of a gapmer comprises at least one LNA nucleoside, at least one non-bicyclic modified nucleoside, and at least one 2'-deoxynucleoside.

In certain embodiments, the 3'-wing of a gapmer comprises at least one bicyclic nucleoside, at least one 2'-substituted nucleoside, and at least one 2'-deoxynucleoside. In certain embodiments, the 3'-wing of a gapmer comprises at least one constrained ethyl nucleoside, at least one 2'-substituted nucleoside, and at least one 2'-deoxynucleoside. In certain embodiments, the 3'-wing of a gapmer comprises at least one LNA nucleoside, at least one 2'-substituted nucleoside, and at least one 2'-deoxynucleoside.

In certain embodiments, the 3'-wing of a gapmer comprises at least one bicyclic nucleoside, at least one 2'-MOE nucleoside, and at least one 2'-deoxynucleoside. In certain embodiments, the 3'-wing of a gapmer comprises at least one constrained ethyl nucleoside, at least one 2'-MOE nucleoside, and at least one 2'-deoxynucleoside. In certain embodiments, the 3'-wing of a gapmer comprises at least one LNA nucleoside, at least one 2'-MOE nucleoside, and at least one 2'-deoxynucleoside.

In certain embodiments, the 3'-wing of a gapmer comprises at least one bicyclic nucleoside, at least one 2'-OMe nucleoside, and at least one 2'-deoxynucleoside. In certain embodiments, the 3'-wing of a gapmer comprises at least one constrained ethyl nucleoside, at least one 2'-OMe nucleoside, and at least one 2'-deoxynucleoside. In certain embodiments, the 3'-wing of a gapmer comprises at least one LNA nucleoside, at least one 2'-OMe nucleoside, and at least one 2'-deoxynucleoside.

iii. Certain Central Regions (Gaps)

In certain embodiments, the gap of a gapmer consists of 6 to 20 linked nucleosides. In certain embodiments, the gap of a gapmer consists of 6 to 15 linked nucleosides. In certain embodiments, the gap of a gapmer consists of 6 to 12 linked nucleosides. In certain embodiments, the gap of a gapmer consists of 6 to 10 linked nucleosides. In certain embodiments, the gap of a gapmer consists of 6 to 9 linked nucleosides. In certain embodiments, the gap of a gapmer consists of 6 to 8 linked nucleosides. In certain embodiments, the gap of a gapmer consists of 6 or 7 linked nucleosides. In certain embodiments, the gap of a gapmer consists of 7 to 10 linked nucleosides. In certain embodiments, the gap of a gapmer consists of 7 to 9 linked nucleosides. In certain embodiments, the gap of a gapmer consists of 7 or 8 linked nucleosides. In certain embodiments, the gap of a gapmer consists of 8 to 10 linked nucleosides. In certain embodiments, the gap of a gapmer consists of 8 or 9 linked nucleosides. In certain embodiments, the gap of a gapmer consists of 6 linked nucleosides. In certain embodiments, the gap of a gapmer consists of 7 linked nucleosides. In certain embodiments, the gap of a gapmer consists of 8 linked nucleosides. In certain embodiments, the gap of a gapmer consists of 9 linked nucleosides. In certain embodiments, the gap of a gapmer consists of 10 linked nucleosides. In certain embodiments, the gap of a gapmer consists of 11 linked nucleosides. In certain embodiments, the gap of a gapmer consists of 12 linked nucleosides.

In certain embodiments, each nucleoside of the gap of a gapmer is a 2'-deoxynucleoside. In certain embodiments, the gap comprises one or more modified nucleosides. In certain embodiments, each nucleoside of the gap of a gapmer is a 2'-deoxynucleoside or is a modified nucleoside that is "DNA-like." In such embodiments, "DNA-like" means that the nucleoside has similar characteristics to DNA, such that a duplex comprising the gapmer and an RNA molecule is capable of activating RNase H. For example, under certain conditions, 2'-(ara)-F have been shown to support RNase H activation, and thus is DNA-like. In certain embodiments, one or more nucleosides of the gap of a gapmer is not a 2'-deoxynucleoside and is not DNA-like. In certain such embodiments, the gapmer nonetheless supports RNase H activation (e.g., by virtue of the number or placement of the non-DNA nucleosides).

In certain embodiments, gaps comprise a stretch of unmodified 2'-deoxynucleoside interrupted by one or more modified nucleosides, thus resulting in three sub-regions (two stretches of one or more 2'-deoxynucleosides and a stretch of one or more interrupting modified nucleosides). In certain embodiments, no stretch of unmodified 2'-deoxynucleosides is longer than 5, 6, or 7 nucleosides. In certain embodiments, such short stretches is achieved by using short gap regions. In certain embodiments, short stretches are achieved by interrupting a longer gap region.

In certain embodiments, the gap comprises one or more modified nucleosides. In certain embodiments, the gap comprises one or more modified nucleosides selected from among cEt, FHNA, LNA, and 2-thio-thymidine. In certain embodiments, the gap comprises one modified nucleoside. In certain embodiments, the gap comprises a 5'-substituted sugar moiety selected from among 5'-Me, and 5'-(R)-Me. In certain embodiments, the gap comprises two modified nucleosides. In certain embodiments, the gap comprises three modified nucleosides. In certain embodiments, the gap comprises four modified nucleosides. In certain embodiments, the gap comprises two or more modified nucleosides and each modified nucleoside is the same. In certain embodiments, the gap comprises two or more modified nucleosides and each modified nucleoside is different.

In certain embodiments, the gap comprises one or more modified linkages. In certain embodiments, the gap comprises one or more methyl phosphonate linkages. In certain embodiments the gap comprises two or more modified linkages. In certain embodiments, the gap comprises one or more modified linkages and one or more modified nucleosides. In certain embodiments, the gap comprises one modified linkage and one modified nucleoside. In certain embodiments, the gap comprises two modified linkages and two or more modified nucleosides.

b. Certain Internucleoside Linkage Motifs

In certain embodiments, oligonucleotides comprise modified internucleoside linkages arranged along the oligonucleotide or region thereof in a defined pattern or modified internucleoside linkage motif. In certain embodiments, oligonucleotides comprise a region having an alternating internucleoside linkage motif. In certain embodiments, oligonucleotides of the present disclosure comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate internucleoside linkages. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 7 phosphorothioate internucleoside linkages. In certain embodiments, the oligonucleotide comprises at least 8 phosphorothioate internucleoside linkages. In certain embodiments, the oligonucleotide comprises at least 9 phosphorothioate internucleoside linkages. In certain embodiments, the oligonucleotide comprises at least 10 phosphorothioate internucleoside linkages. In certain embodiments, the oligonucleotide comprises at least 11 phosphorothioate internucleoside linkages. In certain embodiments, the oligonucleotide comprises at least 12 phosphorothioate internucleoside linkages. In certain embodiments, the oligonucleotide comprises at least 13 phosphorothioate internucleoside linkages. In certain embodiments, the oligonucleotide comprises at least 14 phosphorothioate internucleoside linkages.

In certain embodiments, the oligonucleotide comprises at least one block of at least 6 consecutive phosphorothioate internucleoside linkages. In certain embodiments, the oligonucleotide comprises at least one block of at least 7 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 9 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide. In certain embodiments, the oligonucleotide comprises less than 15 phosphorothioate internucleoside linkages. In certain embodiments, the oligonucleotide comprises less than 14 phosphorothioate internucleoside linkages. In certain embodiments, the oligonucleotide comprises less than 13 phosphorothioate internucleoside linkages. In certain embodiments, the oligonucleotide comprises less than 12 phosphorothioate internucleoside linkages. In certain embodiments, the oligonucleotide comprises less than 11 phosphorothioate internucleoside linkages. In certain embodiments, the oligonucleotide comprises less than 10 phosphorothioate internucleoside linkages. In certain embodiments, the oligonucleotide comprises less than 9 phosphorothioate internucleoside linkages. In certain embodiments, the oligonucleotide comprises less than 8 phosphorothioate internucleoside linkages. In certain embodiments, the oligonucleotide comprises less than 7 phosphorothioate internucleoside linkages. In certain embodiments, the oligonucleotide comprises less than 6 phosphorothioate internucleoside linkages. In certain embodiments, the oligonucleotide comprises less than 5 phosphorothioate internucleoside linkages.

c. Certain Nucleobase Modification Motifs

In certain embodiments, oligonucleotides comprise chemical modifications to nucleobases arranged along the oligonucleotide or region thereof in a defined pattern or nucleobases modification motif. In certain such embodiments, nucleobase modifications are arranged in a gapped motif. In certain embodiments, nucleobase modifications are arranged in an alternating motif. In certain embodiments, each nucleobase is modified. In certain embodiments, none of the nucleobases is chemically modified.

In certain embodiments, oligonucleotides comprise a block of modified nucleobases. In certain such embodiments, the block is at the 3'-end of the oligonucleotide. In certain embodiments the block is within 3 nucleotides of the 3'-end of the oligonucleotide. In certain such embodiments, the block is at the 5'-end of the oligonucleotide. In certain embodiments the block is within 3 nucleotides of the 5'-end of the oligonucleotide.

In certain embodiments, nucleobase modifications are a function of the natural base at a particular position of an oligonucleotide. For example, in certain embodiments each purine or each pyrimidine in an oligonucleotide is modified. In certain embodiments, each adenine is modified. In certain embodiments, each guanine is modified. In certain embodiments, each thymine is modified. In certain embodiments, each cytosine is modified. In certain embodiments, each uracil is modified.

In certain embodiments, some, all, or none of the cytosine moieties in an oligonucleotide are 5-methyl cytosine moieties. Herein, 5-methyl cytosine is not a "modified nucleobase." Accordingly, unless otherwise indicated, unmodified nucleobases include both cytosine residues having a 5-methyl and those lacking a 5 methyl. In certain embodiments, the methylation state of all or some cytosine nucleobases is specified.

In certain embodiments, chemical modifications to nucleobases comprise attachment of certain conjugate groups to nucleobases. In certain embodiments, each purine or each pyrimidine in an oligonucleotide may be optionally modified to comprise a conjugate group.

d. Certain Overall Lengths

In certain embodiments, the present disclosure provides oligonucleotides of any of a variety of ranges of lengths. In certain embodiments, oligonucleotides consist of X to Y linked nucleosides, where X represents the fewest number of nucleosides in the range and Y represents the largest number of nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, the oligonucleotide may consist of 8 to 9, 8 to 10, 8 to 11, 8 to 12, 8 to 13, 8 to 14, 8 to 15, 8 to 16, 8 to 17, 8 to 18, 8 to 19, 8 to 20, 8 to 21, 8 to 22, 8 to 23, 8 to 24, 8 to 25, 8 to 26, 8 to 27, 8 to 28, 8 to 29, 8 to 30, 9 to 10, 9 to 11, 9 to 12, 9 to 13, 9 to 14, 9 to 15, 9 to 16, 9 to 17, 9 to 18, 9 to 19, 9 to 20, 9 to 21, 9 to 22, 9 to 23, 9 to 24, 9 to 25, 9 to 26, 9 to 27, 9 to 28, 9 to 29, 9 to 30, 10 to 11, 10 to 12, 10 to 13, 10 to 14, 10 to 15, 10 to 16, 10 to 17, 10 to 18, 10 to 19, 10 to 20, 10 to 21, 10 to 22, 10 to 23, 10 to 24, 10 to 25, 10 to 26, 10 to 27, to 28, 10 to 29, 10 to 30, 11 to 12, 11 to 13, 11 to 14, 11 to 15, 11 to 16, 11 to 17, 11 to 18, 11 to 19, 11 to 20, 11 to 21, 11 to 22, 11 to 23, 11 to 24, 11 to 25, 11 to 26, 11 to 27, 11 to 28, 11 to 29, 11 to 30, 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides. In embodiments where the number of nucleosides of an oligonucleotide of a compound is limited, whether to a range or to a specific number, the compound may, nonetheless further comprise additional other substituents. For example, an oligonucleotide comprising 8-30 nucleosides excludes oligonucleotides having 31 nucleosides, but, unless otherwise indicated, such an oligonucleotide may further comprise, for example one or more conjugate groups, terminal groups, or other substituents.

Further, where an oligonucleotide is described by an overall length range and by regions having specified lengths, and where the sum of specified lengths of the regions is less than the upper limit of the overall length range, the oligonucleotide may have additional nucleosides, beyond those of the specified regions, provided that the total number of nucleosides does not exceed the upper limit of the overall length range.

5. Certain Antisense Oligonucleotide Chemistry Motifs

In certain embodiments, the chemical structural features of antisense oligonucleotides are characterized by their sugar motif, internucleoside linkage motif, nucleobase modification motif and overall length. In certain embodiments, such parameters are each independent of one another. Thus, each internucleoside linkage of an oligonucleotide having a gapmer sugar motif may be modified or unmodified and may or may not follow the gapmer modification pattern of the sugar modifications. Thus, the internucleoside linkages within the wing regions of a sugar-gapmer may be the same or different from one another and may be the same or different from the internucleoside linkages of the gap region. Likewise, such sugar-gapmer oligonucleotides may comprise one or more modified nucleobase independent of the gapmer pattern of the sugar modifications. One of skill in the art will appreciate that such motifs may be combined to create a variety of oligonucleotides.

In certain embodiments, the selection of internucleoside linkage and nucleoside modification are not independent of one another.

i. Certain Sequences and Targets

In certain embodiments, the invention provides antisense oligonucleotides having a sequence complementary to a target nucleic acid. Such antisense compounds are capable of hybridizing to a target nucleic acid, resulting in at least one antisense activity. In certain embodiments, antisense compounds specifically hybridize to one or more target nucleic acid. In certain embodiments, a specifically hybridizing antisense compound has a nucleobase sequence comprising a region having sufficient complementarity to a target nucleic acid to allow hybridization and result in antisense activity and insufficient complementarity to any non-target so as to avoid or reduce non-specific hybridization to non-target nucleic acid sequences under conditions in which specific hybridization is desired (e.g., under physiological conditions for in vivo or therapeutic uses, and under conditions in which assays are performed in the case of in vitro assays). In certain embodiments, oligonucleotides are selective between a target and non-target, even though both target and non-target comprise the target sequence. In such embodiments, selectivity may result from relative accessibility of the target region of one nucleic acid molecule compared to the other.

In certain embodiments, the present disclosure provides antisense compounds comprising oligonucleotides that are fully complementary to the target nucleic acid over the entire length of the oligonucleotide. In certain embodiments, oligonucleotides are 99% complementary to the target nucleic acid.

In certain embodiments, oligonucleotides are 95% complementary to the target nucleic acid. In certain embodiments, such oligonucleotides are 90% complementary to the target nucleic acid.

In certain embodiments, such oligonucleotides are 85% complementary to the target nucleic acid. In certain embodiments, such oligonucleotides are 80% complementary to the target nucleic acid. In certain embodiments, an antisense compound comprises a region that is fully complementary to a target nucleic acid and is at least 80% complementary to the target nucleic acid over the entire length of the oligonucleotide. In certain such embodiments, the region of full complementarity is from 6 to 14 nucleobases in length.

In certain embodiments, oligonucleotides comprise a hybridizing region and a terminal region. In certain such embodiments, the hybridizing region consists of 12-30 linked nucleosides and is fully complementary to the target nucleic acid. In certain embodiments, the hybridizing region includes one mismatch relative to the target nucleic acid. In certain embodiments, the hybridizing region includes two mismatches relative to the target nucleic acid. In certain embodiments, the hybridizing region includes three mismatches relative to the target nucleic acid. In certain embodiments, the terminal region consists of 1-4 terminal nucleosides. In certain embodiments, the terminal nucleosides are at the 3' end. In certain embodiments, one or more of the terminal nucleosides are not complementary to the target nucleic acid.

Antisense mechanisms include any mechanism involving the hybridization of an oligonucleotide with target nucleic acid, wherein the hybridization results in a biological effect. In certain embodiments, such hybridization results in either target nucleic acid degradation or occupancy with concomitant inhibition or stimulation of the cellular machinery involving, for example, translation, transcription, or splicing of the target nucleic acid.

One type of antisense mechanism involving degradation of target RNA is RNase H mediated antisense. RNase H is a cellular endonuclease which cleaves the RNA strand of an RNA:DNA duplex. It is known in the art that single-stranded antisense compounds which are "DNA-like" elicit RNase H activity in mammalian cells. Activation of RNase H, therefore, results in cleavage of the RNA target, thereby greatly enhancing the efficiency of DNA-like oligonucleotide-mediated inhibition of gene expression.

In certain embodiments, a conjugate group comprises a cleavable moiety. In certain embodiments, a conjugate group comprises one or more cleavable bond. In certain embodiments, a conjugate group comprises a linker. In certain embodiments, a linker comprises a protein binding moiety. In certain embodiments, a conjugate group comprises a cell-targeting moiety (also referred to as a cell-targeting group). In certain embodiments a cell-targeting moiety comprises a branching group. In certain embodiments, a cell-targeting moiety comprises one or more tethers. In certain embodiments, a cell-targeting moiety comprises a carbohydrate or carbohydrate cluster.

ii. Certain Cleavable Moieties

In certain embodiments, a cleavable moiety is a cleavable bond. In certain embodiments, a cleavable moiety comprises a cleavable bond. In certain embodiments, the conjugate group comprises a cleavable moiety. In certain such embodiments, the cleavable moiety attaches to the antisense oligonucleotide. In certain such embodiments, the cleavable moiety attaches directly to the cell-targeting moiety. In certain such embodiments, the cleavable moiety attaches to the conjugate linker. In certain embodiments, the cleavable moiety comprises a phosphate or phosphodiester. In certain embodiments, the cleavable moiety is a cleavable nucleoside or nucleoside analog. In certain embodiments, the nucleoside or nucleoside analog comprises an optionally protected heterocyclic base selected from a purine, substituted purine, pyrimidine or substituted pyrimidine. In certain embodiments, the cleavable moiety is a nucleoside comprising an optionally protected heterocyclic base selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. In certain embodiments, the cleavable moiety is 2'-deoxy nucleoside that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester linkage.

In certain embodiments, the cleavable moiety is attached to the 3' position of the antisense oligonucleotide. In certain embodiments, the cleavable moiety is attached to the 5' position of the antisense oligonucleotide. In certain embodiments, the cleavable moiety is attached to a 2' position of the antisense oligonucleotide. In certain embodiments, the cleavable moiety is attached to the antisense oligonucleotide by a phosphodiester linkage. In certain embodiments, the cleavable moiety is attached to the linker by either a phosphodiester or a phosphorothioate linkage. In certain embodiments, the cleavable moiety is attached to the linker by a phosphodiester linkage. In certain embodiments, the conjugate group does not include a cleavable moiety.

In certain embodiments, the cleavable moiety is cleaved after the complex has been administered to an animal only after being internalized by a targeted cell. Inside the cell the cleavable moiety is cleaved thereby releasing the active antisense oligonucleotide. While not wanting to be bound by theory it is believed that the cleavable moiety is cleaved by one or more nucleases within the cell. In certain embodiments, the one or more nucleases cleave the phosphodiester linkage between the cleavable moiety and the linker. In certain embodiments, the cleavable moiety has a structure selected from among the following:

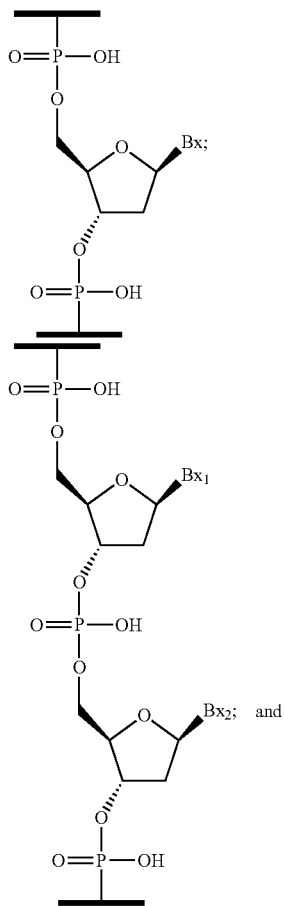

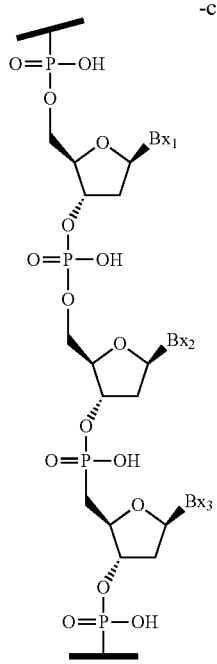

wherein each of Bx, $Bx_1$, $Bx_2$, and $Bx_3$ is independently a heterocyclic base moiety. In certain embodiments, the cleavable moiety has a structure selected from among the following:

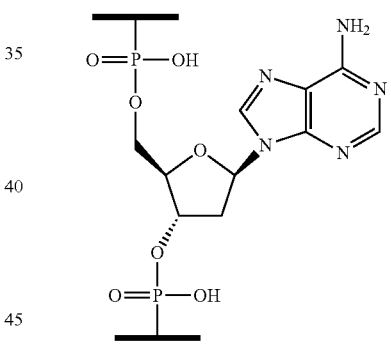

iii. Certain Linkers

In certain embodiments, the conjugate groups comprise a linker. In certain such embodiments, the linker is covalently bound to the cleavable moiety. In certain such embodiments, the linker is covalently bound to the antisense oligonucleotide. In certain embodiments, the linker is covalently bound to a cell-targeting moiety. In certain embodiments, the linker further comprises a covalent attachment to a solid support. In certain embodiments, the linker further comprises a covalent attachment to a protein binding moiety. In certain embodiments, the linker further comprises a covalent attachment to a solid support and further comprises a covalent attachment to a protein binding moiety. In certain embodiments, the linker includes multiple positions for attachment of tethered ligands. In certain embodiments, the linker includes multiple positions for attachment of tethered ligands and is not attached to a branching group. In certain embodiments, the linker further comprises one or more cleavable bond. In certain embodiments, the conjugate group does not include a linker.

In certain embodiments, the linker includes at least a linear group comprising groups selected from alkyl, amide, disulfide, polyethylene glycol, ether, thioether (—S—) and hydroxylamino (—O—N(H)—) groups. In certain embodiments, the linear group comprises groups selected from alkyl, amide and ether groups. In certain embodiments, the linear group comprises groups selected from alkyl and ether groups. In certain embodiments, the linear group comprises at least one phosphorus linking group. In certain embodiments, the linear group comprises at least one phosphodiester group. In certain embodiments, the linear group includes at least one neutral linking group. In certain embodiments, the linear group is covalently attached to the cell-targeting moiety and the cleavable moiety. In certain embodiments, the linear group is covalently attached to the cell-targeting moiety and the antisense oligonucleotide. In certain embodiments, the linear group is covalently attached to the cell-targeting moiety, the cleavable moiety and a solid support. In certain embodiments, the linear group is covalently attached to the cell-targeting moiety, the cleavable moiety, a solid support and a protein binding moiety. In certain embodiments, the linear group includes one or more cleavable bond.

In certain embodiments, the linker includes the linear group covalently attached to a scaffold group. In certain embodiments, the scaffold includes a branched aliphatic group comprising groups selected from alkyl, amide, disulfide, polyethylene glycol, ether, thioether and hydroxylamino groups. In certain embodiments, the scaffold includes a branched aliphatic group comprising groups selected from alkyl, amide and ether groups. In certain embodiments, the scaffold includes at least one mono or polycyclic ring system. In certain embodiments, the scaffold includes at least two mono or polycyclic ring systems. In certain embodiments, the linear group is covalently attached to the scaffold group and the scaffold group is covalently attached to the cleavable moiety and the linker. In certain embodiments, the linear group is covalently attached to the scaffold group and the scaffold group is covalently attached to the cleavable moiety, the linker and a solid support. In certain embodiments, the linear group is covalently attached to the scaffold group and the scaffold group is covalently attached to the cleavable moiety, the linker and a protein binding moiety. In certain embodiments, the linear group is covalently attached to the scaffold group and the scaffold group is covalently attached to the cleavable moiety, the linker, a protein binding moiety and a solid support. In certain embodiments, the scaffold group includes one or more cleavable bond.

In certain embodiments, the linker includes a protein binding moiety. In certain embodiments, the protein binding moiety is a lipid such as for example including but not limited to cholesterol, cholic acid, adamantane acetic acid, 1-pyrene butyric acid, dihydrotestosterone, 1,3-Bis-O(hexadecyl) glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid. In certain embodiments, the protein binding moiety is a C16 to C22 long chain saturated or unsaturated fatty acid, cholesterol, cholic acid, vitamin E, adamantane or 1-pentafluoropropyl.

In certain embodiments, a linker has a structure selected from among:

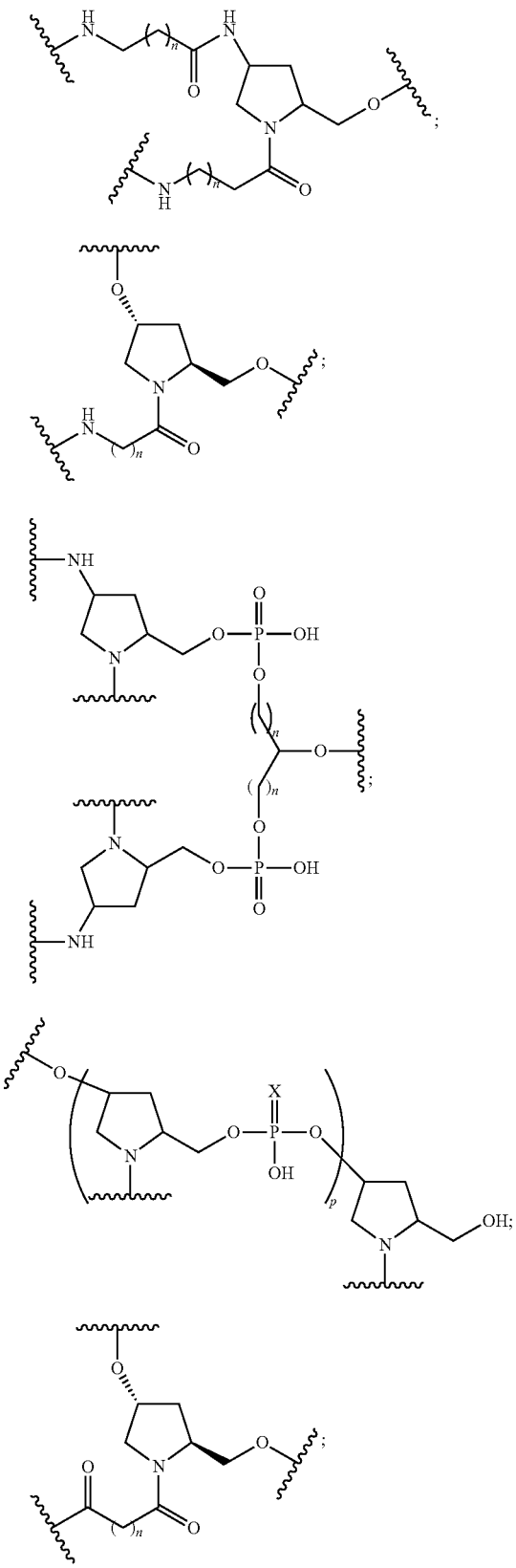

557
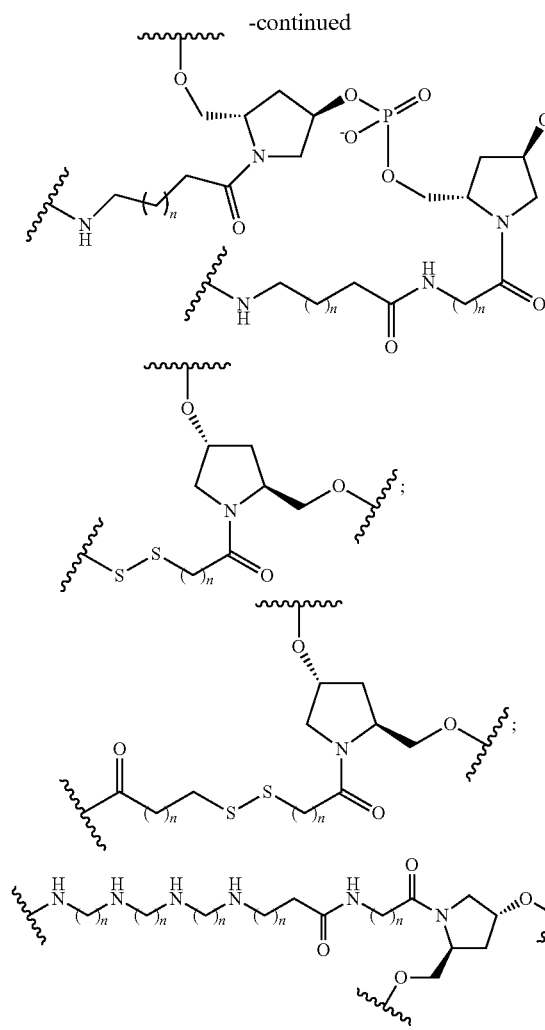
558
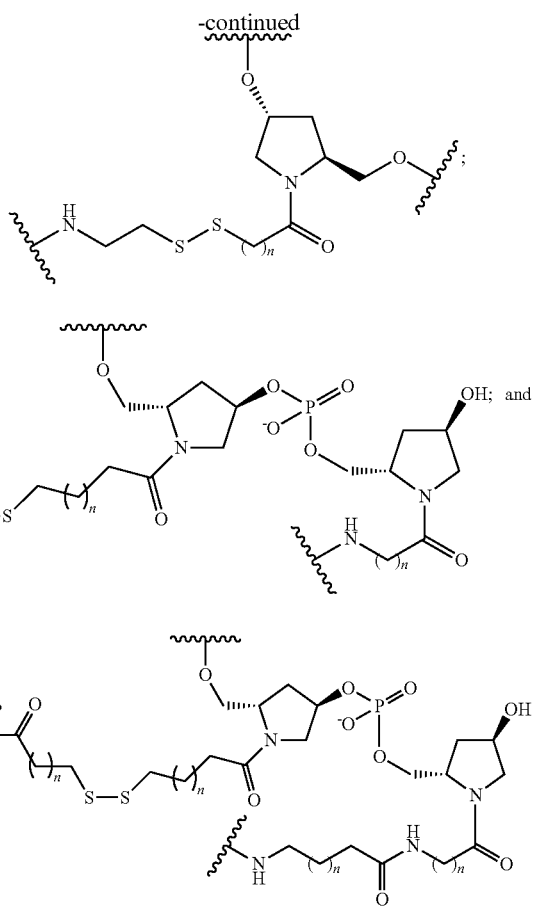
wherein each n is, independently, from 1 to 20; and p is from 1 to 6.
In certain embodiments, a linker has a structure selected from among:
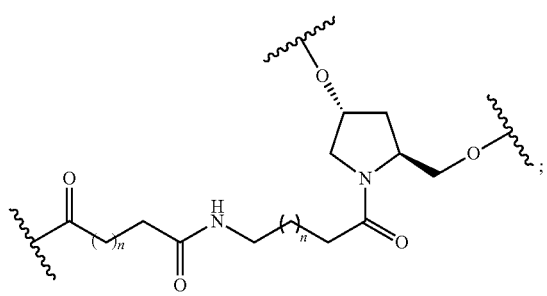
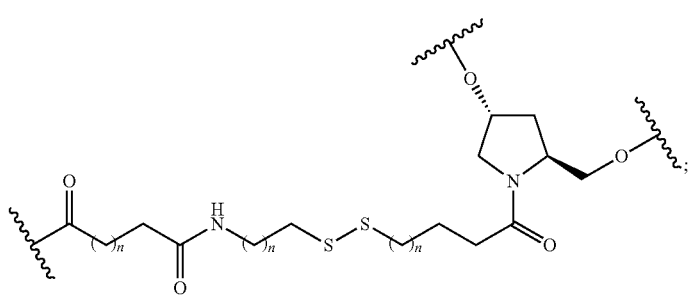

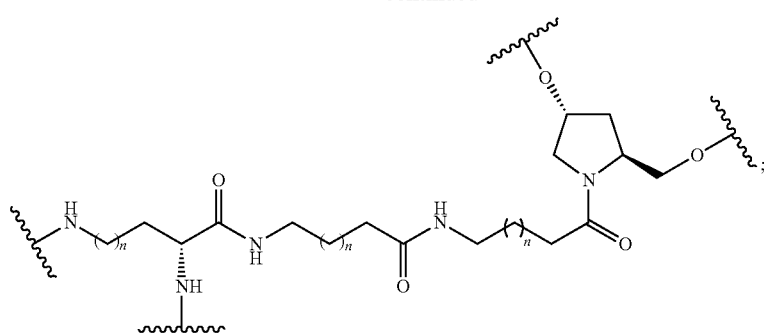
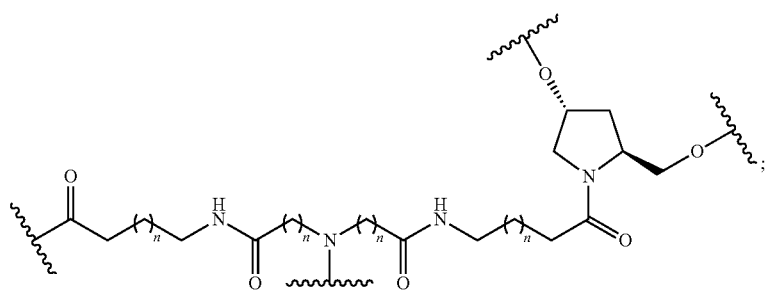
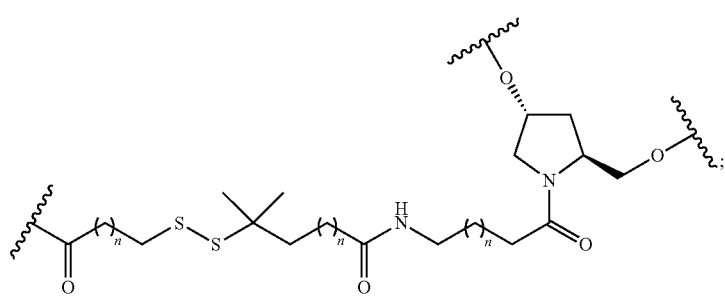
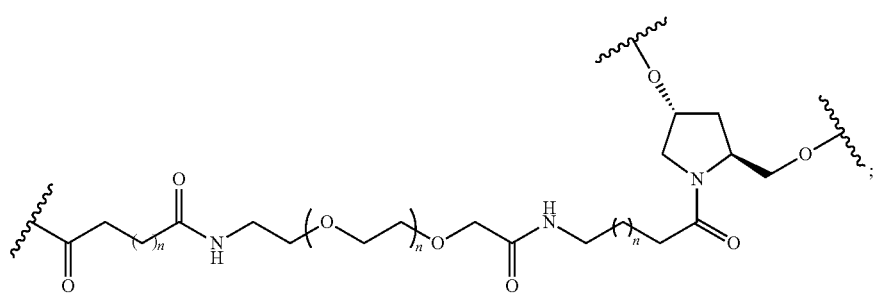
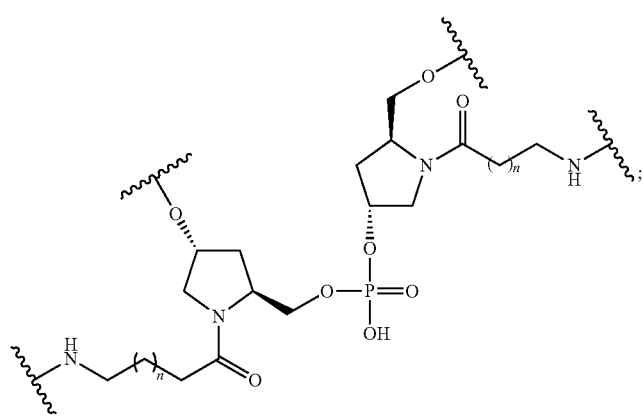

-continued
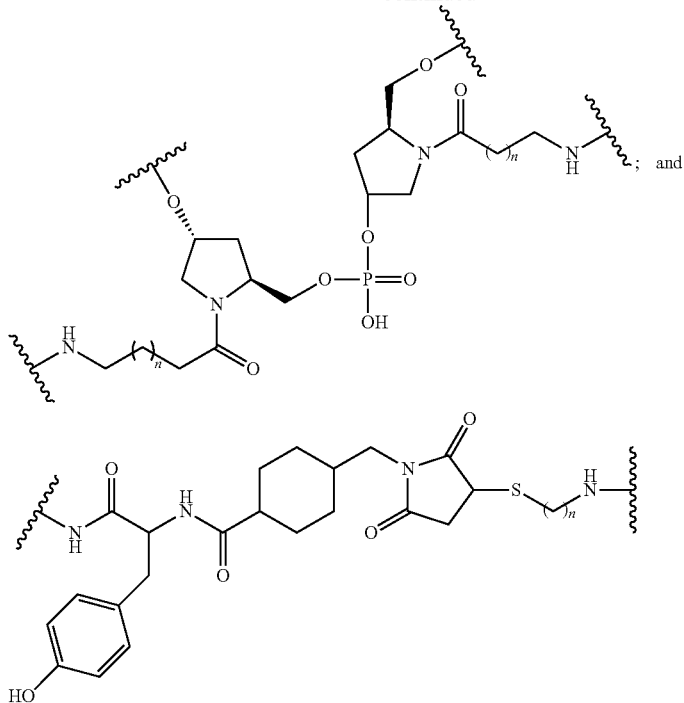
wherein each n is, independently, from 1 to 20.
In certain embodiments, a linker has a structure selected from among:
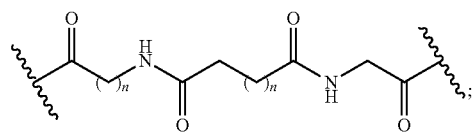
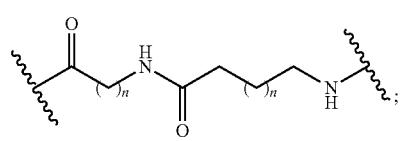
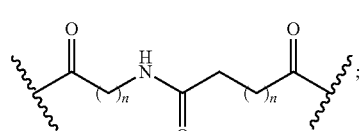
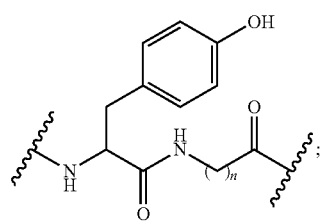
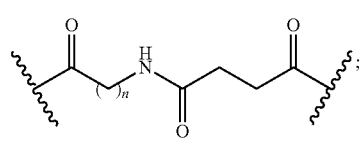
-continued
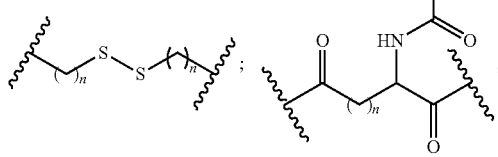
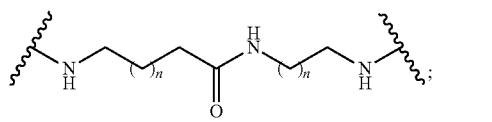
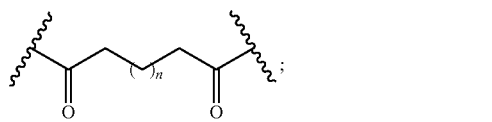
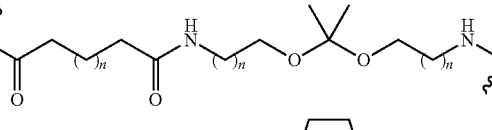
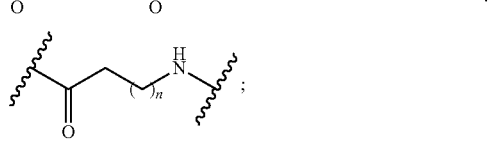

563
-continued
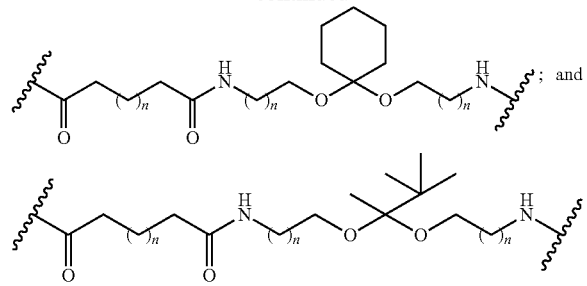
; and
wherein n is from 1 to 20.
In certain embodiments, a linker has a structure selected from among:
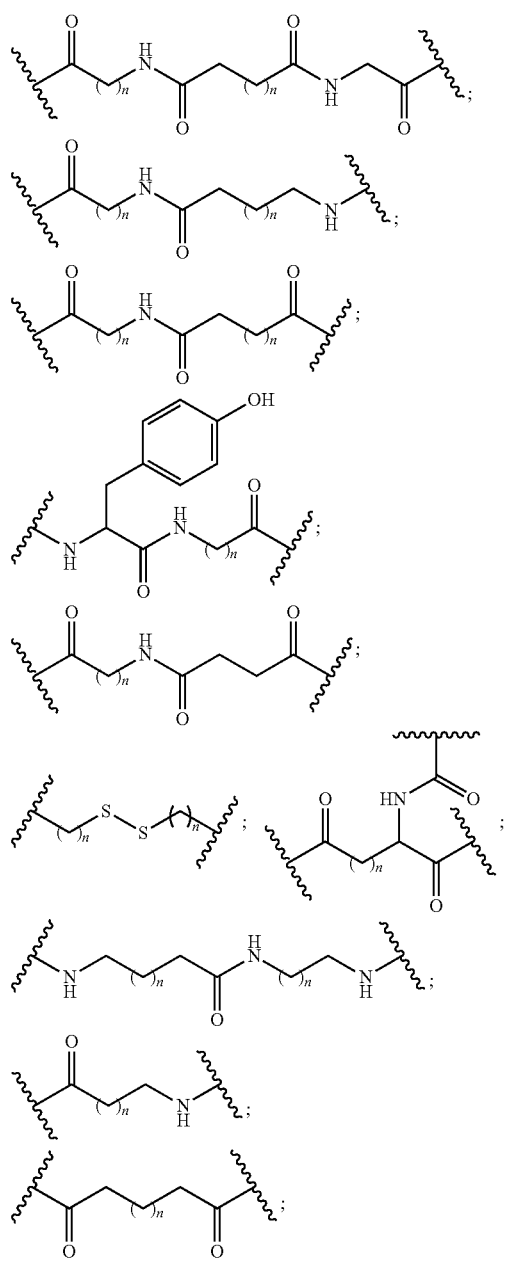
564
-continued
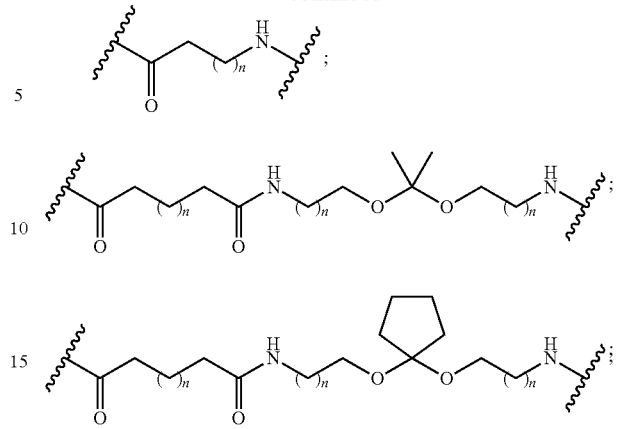
wherein each L is, independently, a phosphorus linking group or a neutral linking group; and
each n is, independently, from 1 to 20.
In certain embodiments, a linker has a structure selected from among:

565
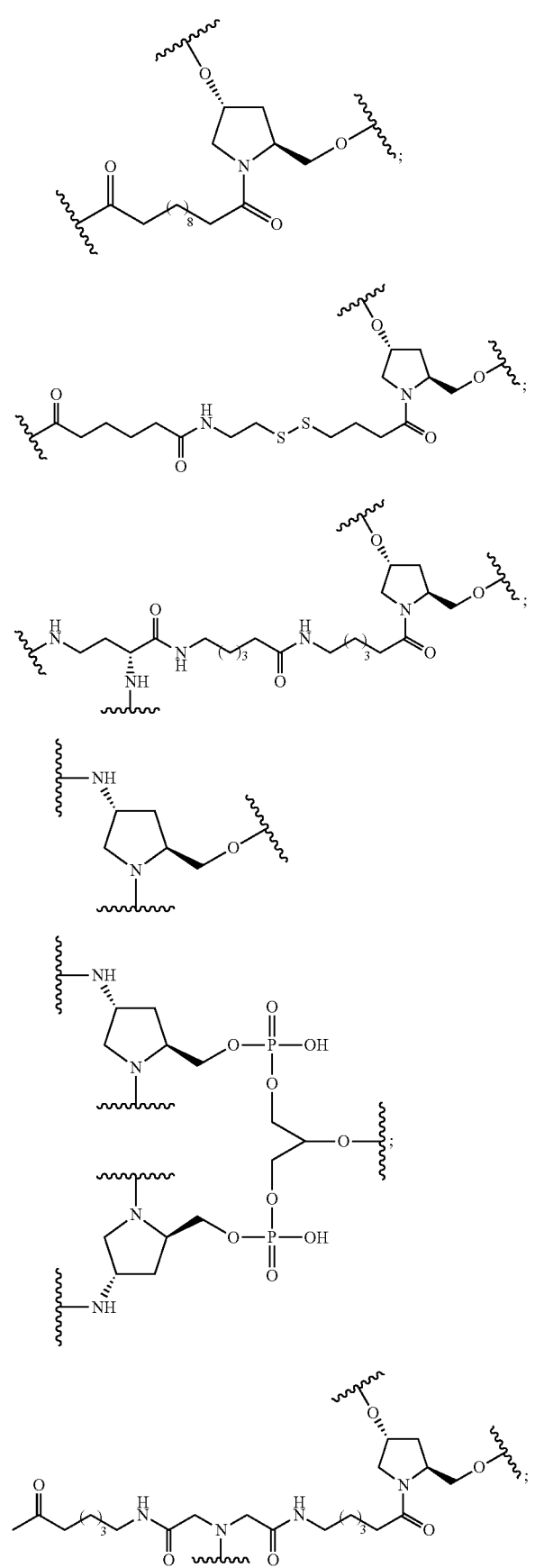
566
-continued
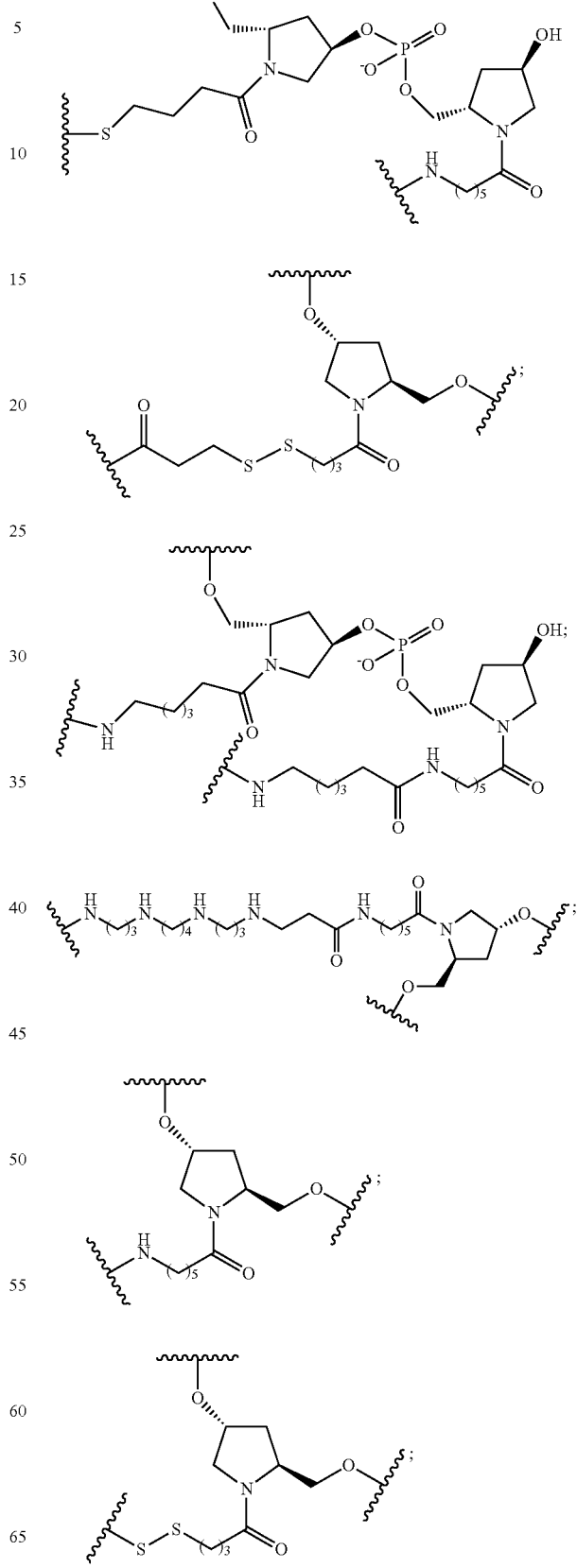

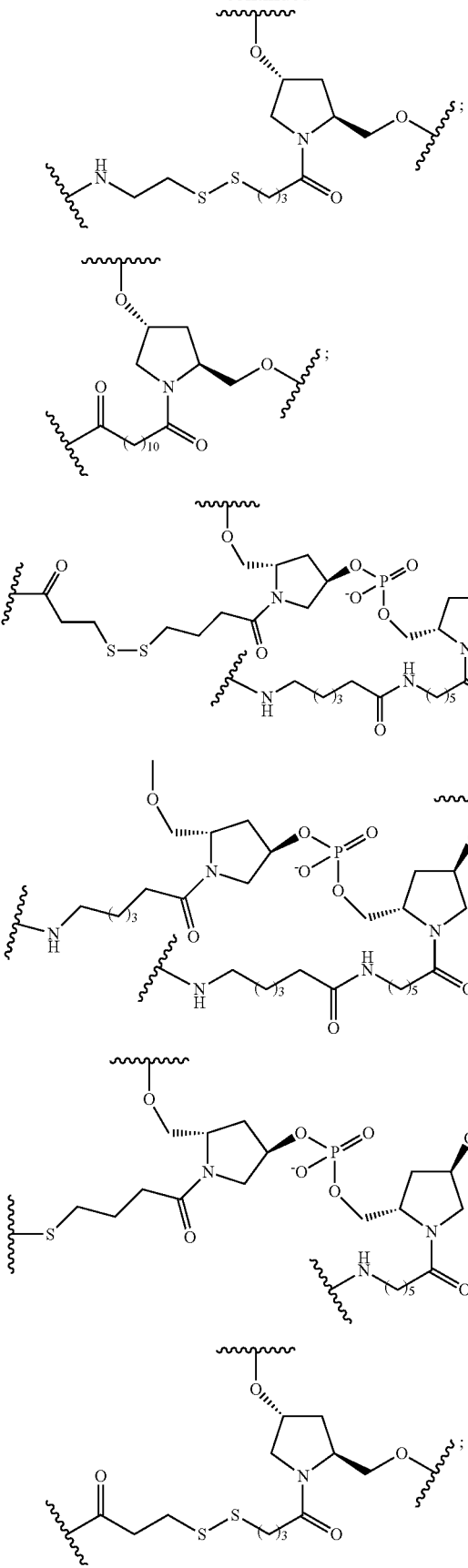
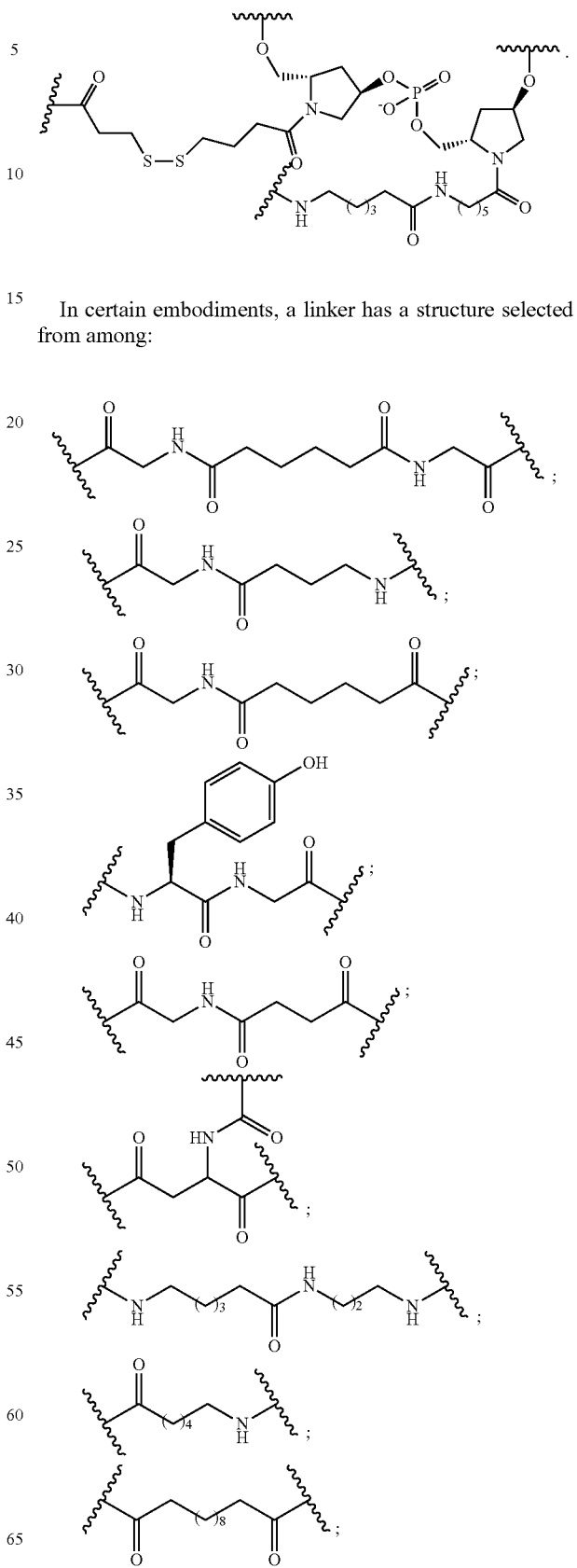
In certain embodiments, a linker has a structure selected from among:

569
-continued
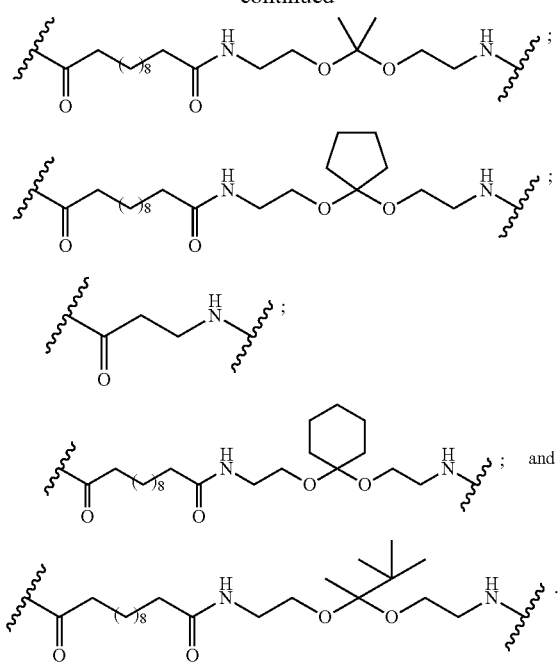
In certain embodiments, a linker has a structure selected from among:
570
-continued
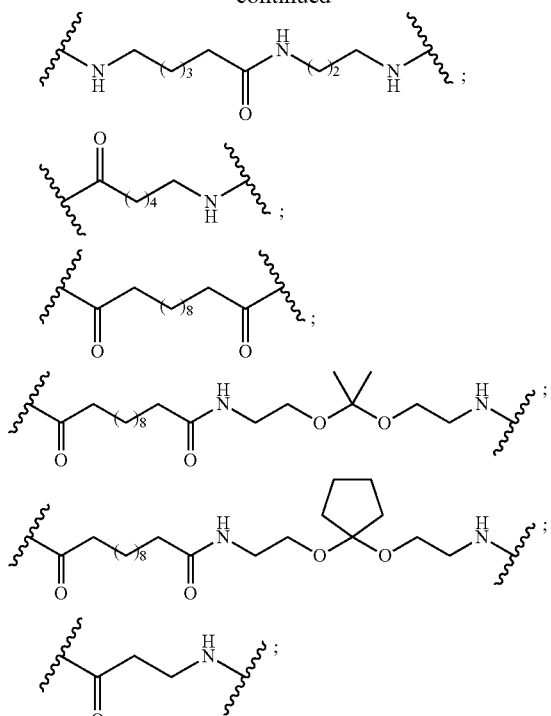
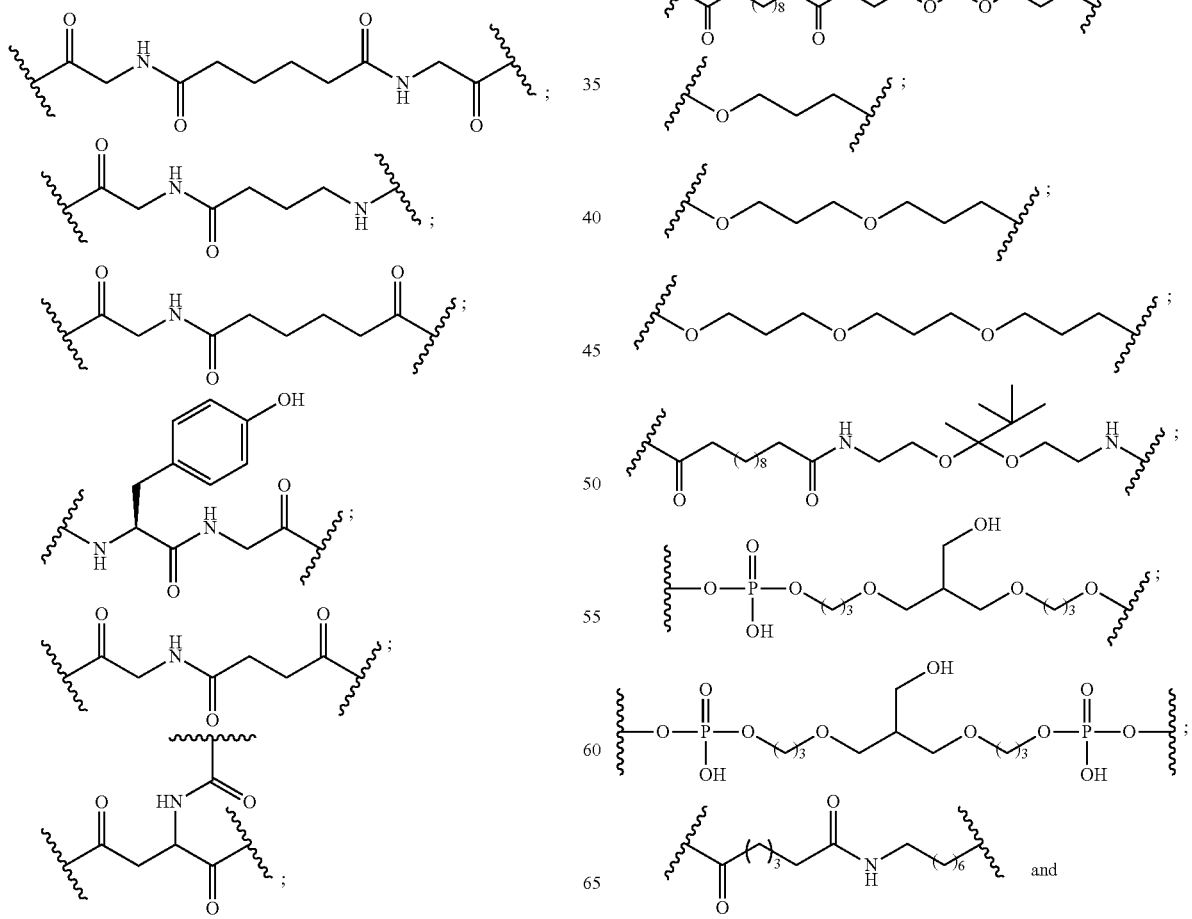

-continued

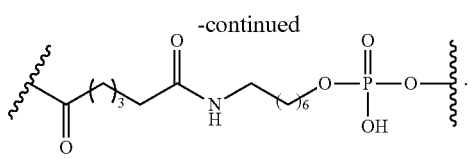

In certain embodiments, a linker has a structure selected from among:

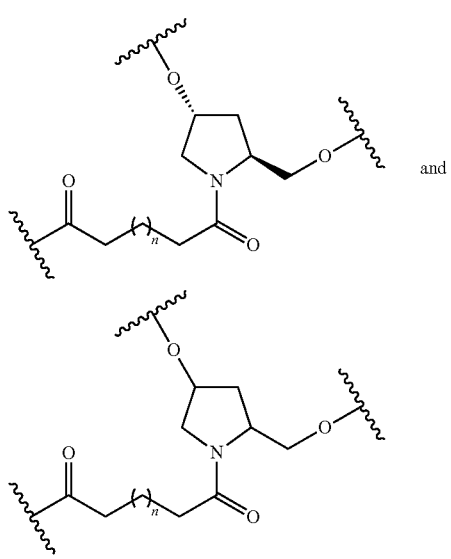

wherein n is from 1 to 20.

In certain embodiments, a linker has a structure selected from among:

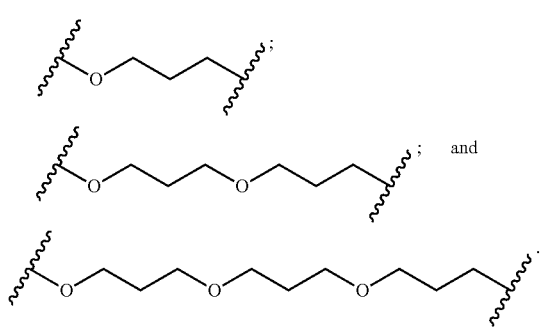

In certain embodiments, a linker has a structure selected from among:

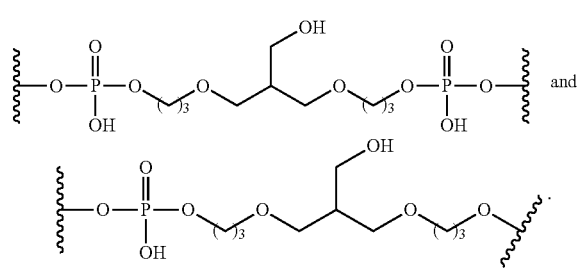

In certain embodiments, a linker has a structure selected from among:

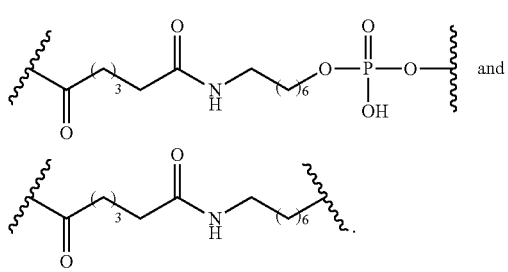

In certain embodiments, the conjugate linker has the structure:

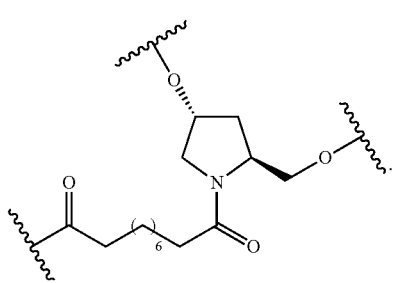

In certain embodiments, the conjugate linker has the structure:

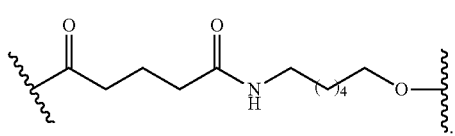

In certain embodiments, a linker has a structure selected from among:

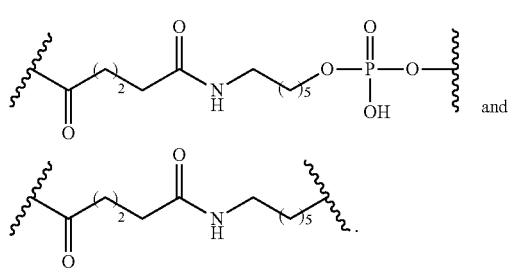

In certain embodiments, a linker has a structure selected from among:

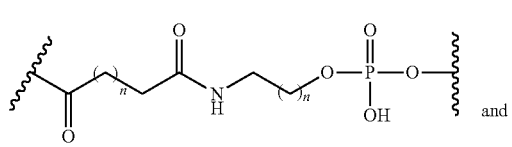

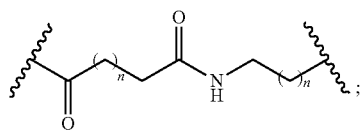

wherein each n is independently, 0, 1, 2, 3, 4, 5, 6, or 7.

iv. Certain Cell-Targeting Moieties

In certain embodiments, conjugate groups comprise cell-targeting moieties. Certain such cell-targeting moieties increase cellular uptake of antisense compounds. In certain embodiments, cell-targeting moieties comprise a branching group, one or more tether, and one or more ligand. In certain embodiments, cell-targeting moieties comprise a branching group, one or more tether, one or more ligand and one or more cleavable bond.

1. Certain Branching Groups

In certain embodiments, the conjugate groups comprise a targeting moiety comprising a branching group and at least two tethered ligands. In certain embodiments, the branching group attaches the conjugate linker. In certain embodiments, the branching group attaches the cleavable moiety. In certain embodiments, the branching group attaches the antisense oligonucleotide. In certain embodiments, the branching group is covalently attached to the linker and each of the tethered ligands. In certain embodiments, the branching group comprises a branched aliphatic group comprising groups selected from alkyl, amide, disulfide, polyethylene glycol, ether, thioether and hydroxylamino groups. In certain embodiments, the branching group comprises groups selected from alkyl, amide and ether groups. In certain embodiments, the branching group comprises groups selected from alkyl and ether groups. In certain embodiments, the branching group comprises a mono or polycyclic ring system. In certain embodiments, the branching group comprises one or more cleavable bond. In certain embodiments, the conjugate group does not include a branching group.

In certain embodiments, a branching group has a structure selected from among:

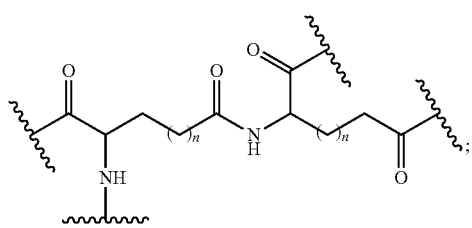

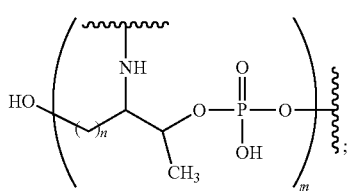

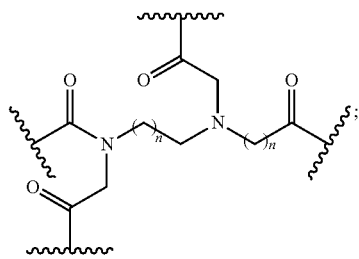

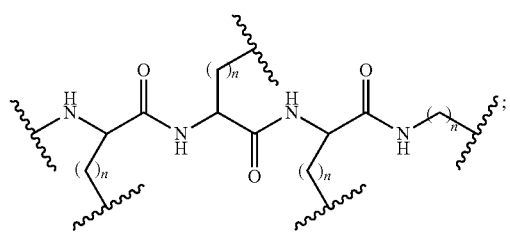

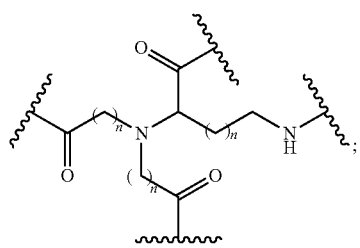

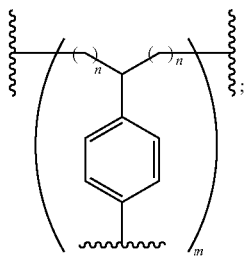 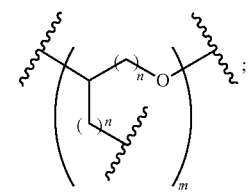

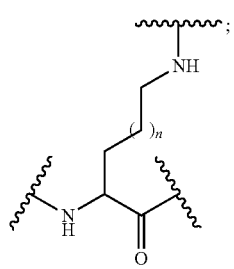

575
-continued
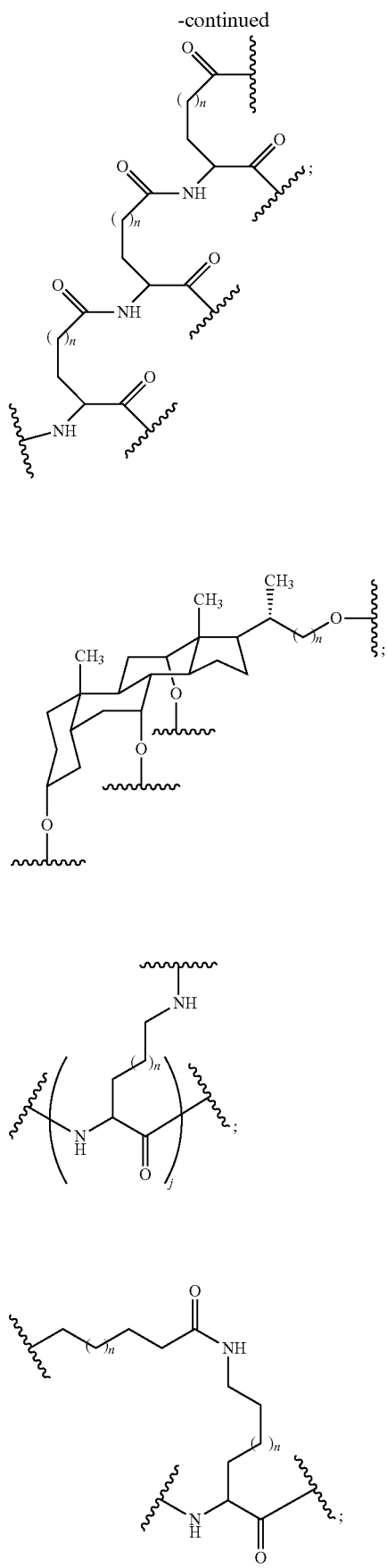
576
-continued
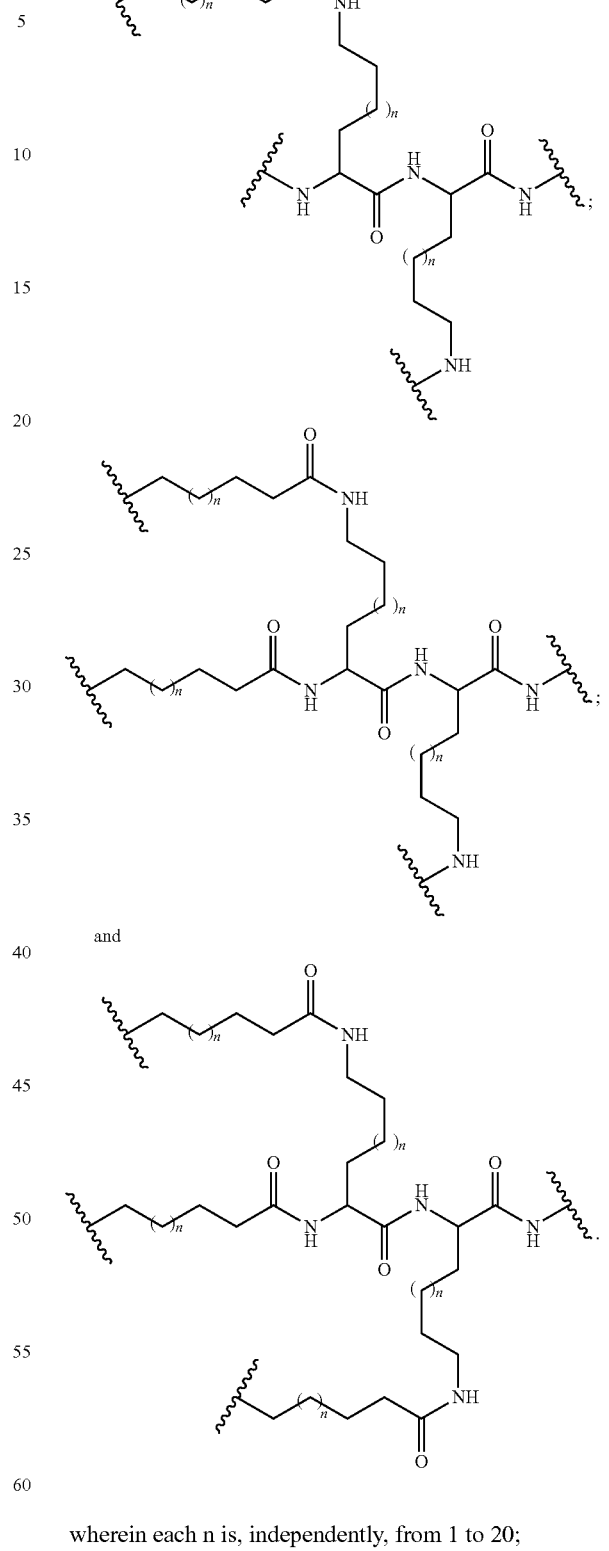
and
wherein each n is, independently, from 1 to 20;
j is from 1 to 3; and
m is from 2 to 6.
In certain embodiments, a branching group has a structure selected from among:

577
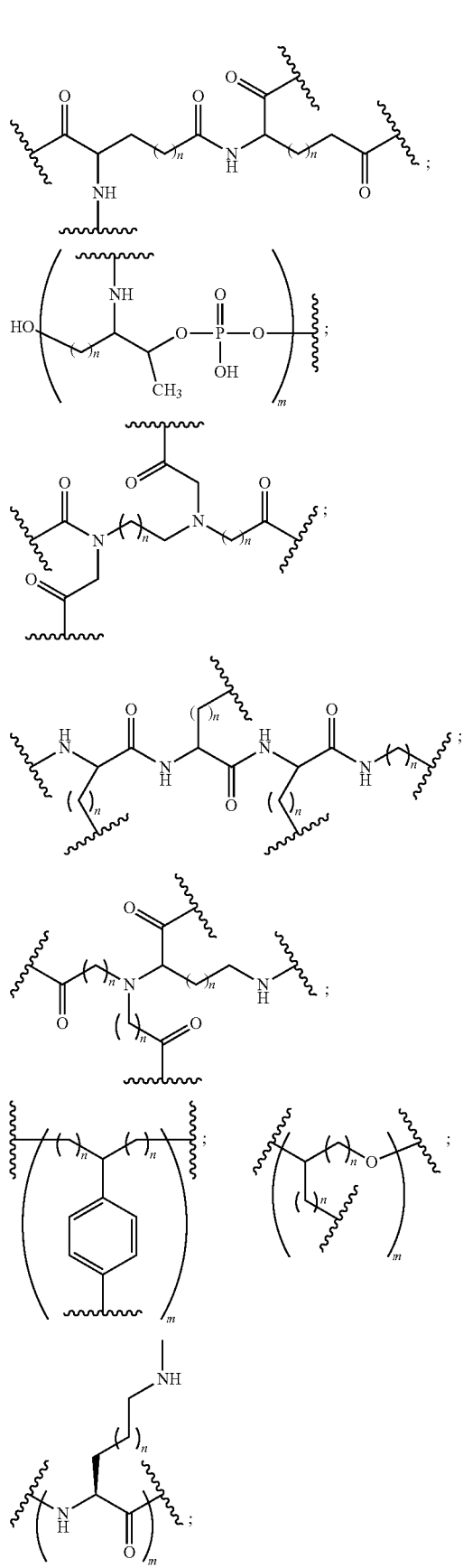
578
-continued
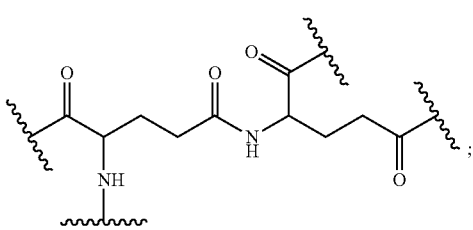
wherein each n is, independently, from 1 to 20; and m is from 2 to 6.
In certain embodiments, a branching group has a structure selected from among:

579
-continued
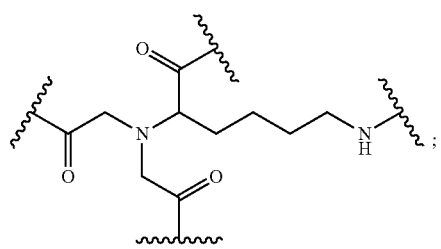
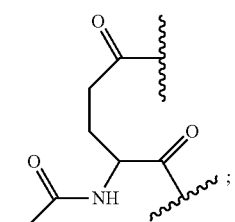
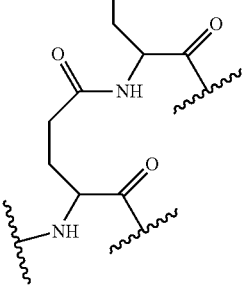
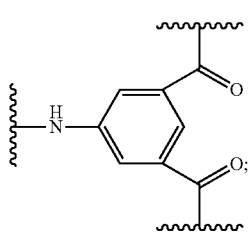
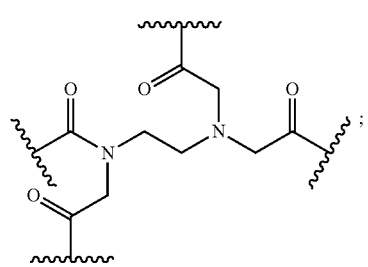
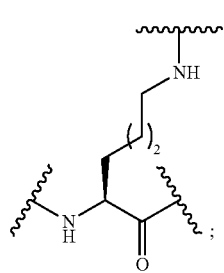
580
-continued
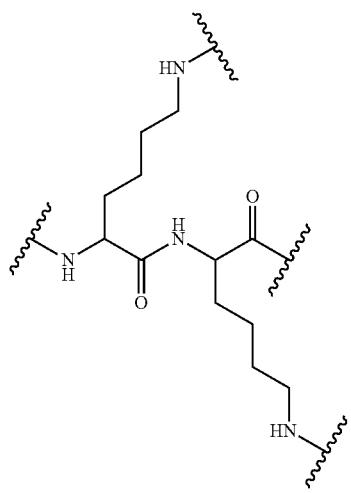
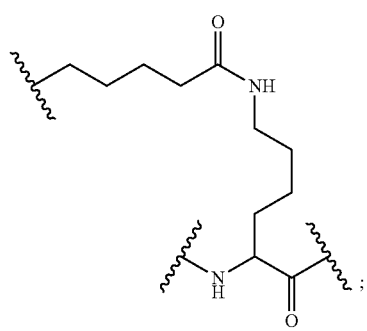
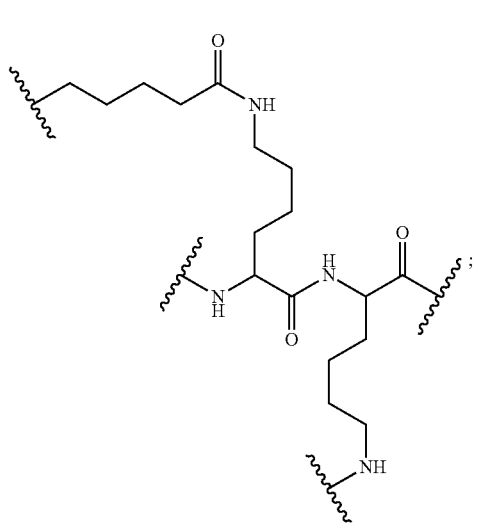

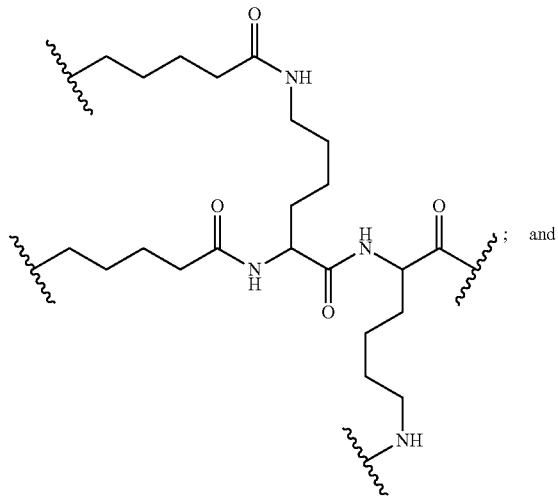

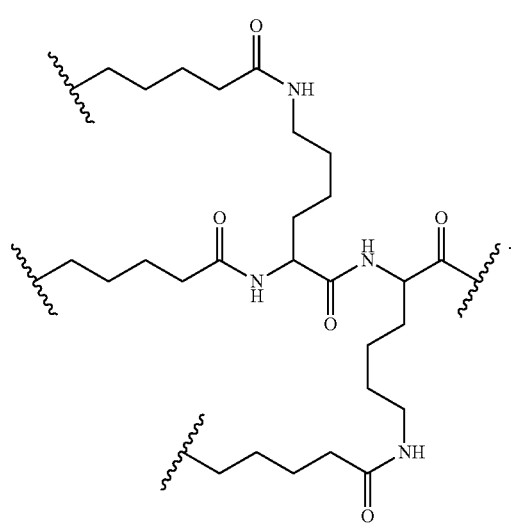

In certain embodiments, a branching group has a structure selected from among:

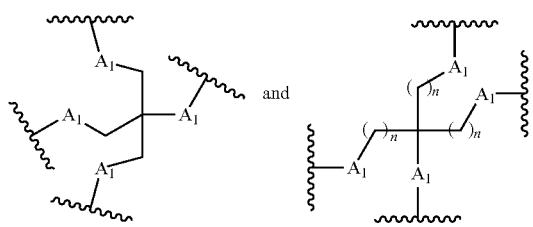

wherein each $A_1$ is independently, O, S, C=O or NH; and each n is, independently, from 1 to 20.

In certain embodiments, a branching group has a structure selected from among:

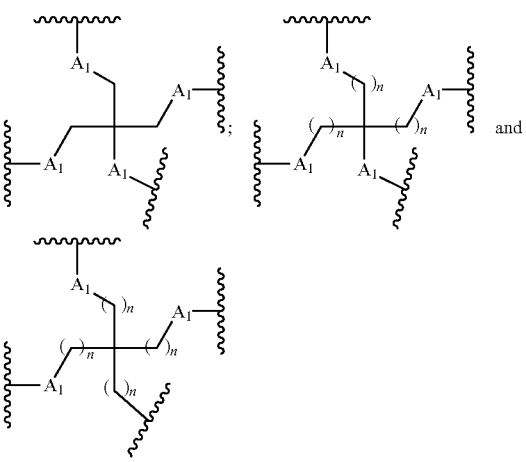

wherein each $A_1$ is independently, O, S, C=O or NH; and each n is, independently, from 1 to 20.

In certain embodiments, a branching group has a structure selected from among:

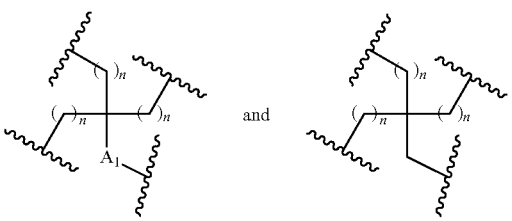

wherein $A_1$ is O, S, C=O or NH; and each n is, independently, from 1 to 20.

In certain embodiments, a branching group has a structure selected from among:

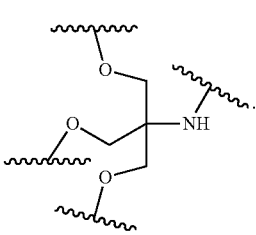 [SMILES: *NC(CO*)(CO*)CO*]

In certain embodiments, a branching group has a structure selected from among:

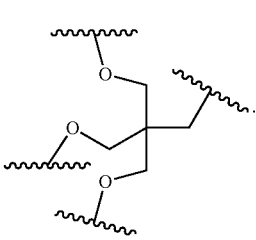 [SMILES: *CC(CO*)(CO*)CO*]

In certain embodiments, a branching group has a structure selected from among:

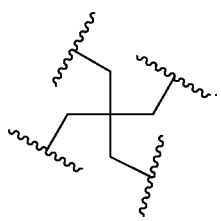 [SMILES: *CC(C*)(C*)C*]

2. Certain Tethers

In certain embodiments, conjugate groups comprise one or more tethers covalently attached to the branching group. In certain embodiments, conjugate groups comprise one or more tethers covalently attached to the linking group. In certain embodiments, each tether is a linear aliphatic group comprising one or more groups selected from alkyl, ether, thioether, disulfide, amide and polyethylene glycol groups in any combination. In certain embodiments, each tether is a linear aliphatic group comprising one or more groups selected from alkyl, substituted alkyl, ether, thioether, disulfide, amide, phosphodiester and polyethylene glycol groups in any combination. In certain embodiments, each tether is a linear aliphatic group comprising one or more groups selected from alkyl, ether and amide groups in any combination. In certain embodiments, each tether is a linear aliphatic group comprising one or more groups selected from alkyl, substituted alkyl, phosphodiester, ether and amide groups in any combination. In certain embodiments, each tether is a linear aliphatic group comprising one or more groups selected from alkyl and phosphodiester in any combination. In certain embodiments, each tether comprises at least one phosphorus linking group or neutral linking group.

In certain embodiments, the tether includes one or more cleavable bond. In certain embodiments, the tether is attached to the branching group through either an amide or an ether group. In certain embodiments, the tether is attached to the branching group through a phosphodiester group. In certain embodiments, the tether is attached to the branching group through a phosphorus linking group or neutral linking group. In certain embodiments, the tether is attached to the branching group through an ether group. In certain embodiments, the tether is attached to the ligand through either an amide or an ether group. In certain embodiments, the tether is attached to the ligand through an ether group. In certain embodiments, the tether is attached to the ligand through either an amide or an ether group. In certain embodiments, the tether is attached to the ligand through an ether group.

In certain embodiments, each tether comprises from about 8 to about 20 atoms in chain length between the ligand and the branching group. In certain embodiments, each tether group comprises from about 10 to about 18 atoms in chain length between the ligand and the branching group. In certain embodiments, each tether group comprises about 13 atoms in chain length.

In certain embodiments, a tether has a structure selected from among:

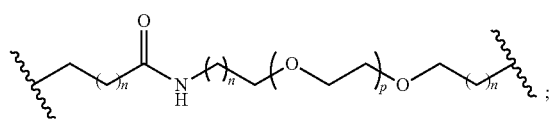

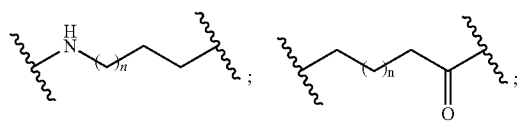

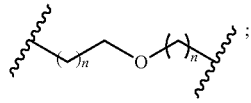

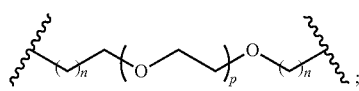

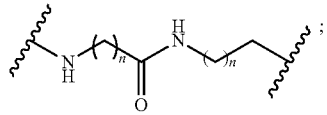

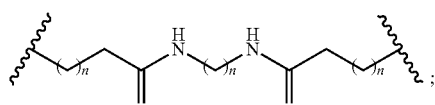

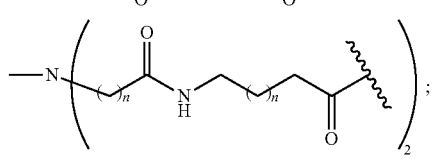

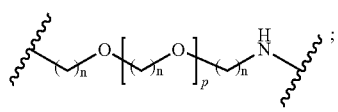

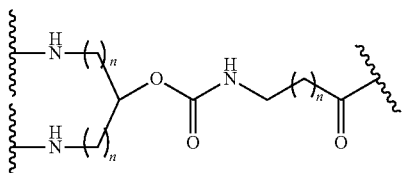

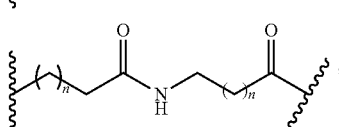

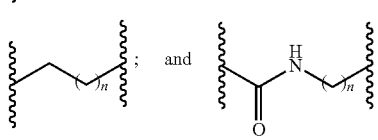

wherein each n is, independently, from 1 to 20; and
each p is from 1 to about 6.

In certain embodiments, a tether has a structure selected from among:

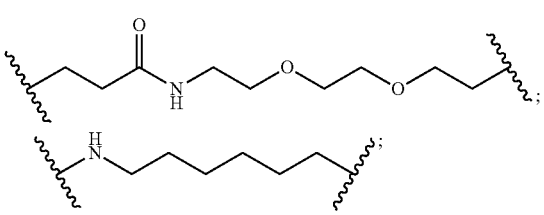

-continued

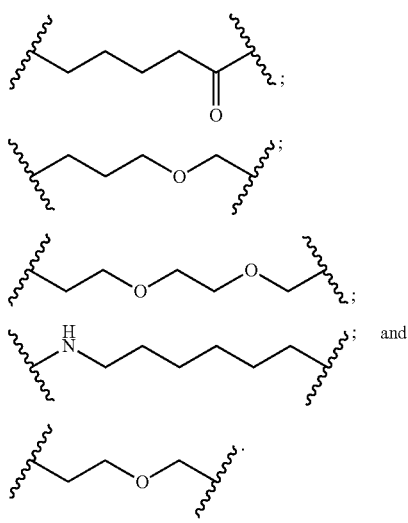

In certain embodiments, a tether has a structure selected from among:

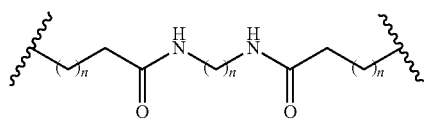

wherein each n is, independently, from 1 to 20.

In certain embodiments, a tether has a structure selected from among:

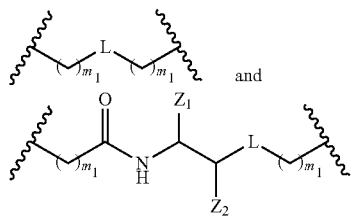

wherein L is either a phosphorus linking group or a neutral linking group;
$Z_1$ is C(=O)O—$R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

In certain embodiments, a tether has a structure selected from among:

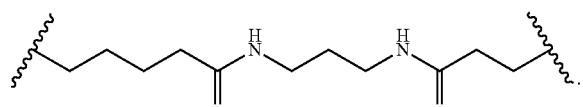

In certain embodiments, a tether has a structure selected from among:

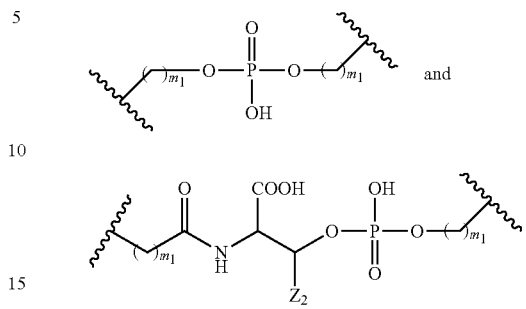

wherein $Z_2$ is H or $CH_3$; and
each $m_1$ is, independently, from 0 to 20 wherein at least one $m_1$ is greater than 0 for each tether.

In certain embodiments, a tether has a structure selected from among:

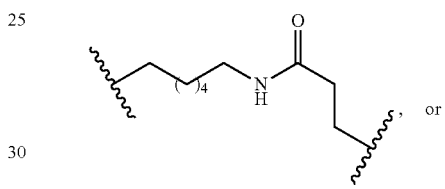, or

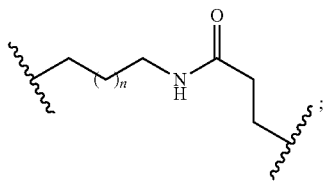;

wherein each n is independently, 0, 1, 2, 3, 4, 5, 6, or 7.

In certain embodiments, a tether comprises a phosphorus linking group. In certain embodiments, a tether does not comprise any amide bonds. In certain embodiments, a tether comprises a phosphorus linking group and does not comprise any amide bonds.

3. Certain Ligands

In certain embodiments, the present disclosure provides ligands wherein each ligand is covalently attached to a tether. In certain embodiments, each ligand is selected to have an affinity for at least one type of receptor on a target cell. In certain embodiments, ligands are selected that have an affinity for at least one type of receptor on the surface of a mammalian liver cell. In certain embodiments, ligands are selected that have an affinity for the hepatic asialoglycoprotein receptor (ASGP-R). In certain embodiments, each ligand is a carbohydrate. In certain embodiments, each ligand is, independently selected from galactose, N-acetyl galactoseamine, mannose, glucose, glucosamone and fucose. In certain embodiments, each ligand is N-acetyl galactoseamine (Gal-NAc). In certain embodiments, the targeting moiety comprises 2 to 6 ligands. In certain embodiments, the targeting moiety comprises 3 ligands. In certain embodiments, the targeting moiety comprises 3 N-acetyl galactoseamine ligands.

In certain embodiments, the ligand is a carbohydrate, carbohydrate derivative, modified carbohydrate, multivalent carbohydrate cluster, polysaccharide, modified polysaccharide, or polysaccharide derivative. In certain embodiments, the ligand is an amino sugar or a thio sugar. For example, amino sugars may be selected from any number of compounds known in the art, for example glucosamine, sialic acid, α-D-galactosamine, N-Acetylgalactosamine, 2-acetamido-2-deoxy-D-galactopyranose (GalNAc), 2-Amino-3-O-[(R)-1-carboxyethyl]-2-deoxy-β-D-glucopyranose (β-muramic acid), 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose and N-sulfo-D-glucosamine, and N-Glycoloyl-α-neuraminic acid. For example, thio sugars may be selected from the group consisting of 5-Thio-β-D-glucopyranose, Methyl 2,3,4-tri-O-acetyl-1-thio-6-O-trityl-α-D-glucopyranoside, 4-Thio-β-D-galactopyranose, and ethyl 3,4,6,7-tetra-O-acetyl-2-deoxy-1,5-dithio-α-D-gluco-heptopyranoside.

In certain embodiments, "GalNac" or "Gal-NAc" refers to 2-(Acetylamino)-2-deoxy-D-galactopyranose, commonly referred to in the literature as N-acetyl galactosamine. In certain embodiments, "N-acetyl galactosamine" refers to 2-(Acetylamino)-2-deoxy-D-galactopyranose. In certain embodiments, "GalNac" or "Gal-NAc" refers to 2-(Acetylamino)-2-deoxy-D-galactopyranose. In certain embodiments, "GalNac" or "Gal-NAc" refers to 2-(Acetylamino)-2-deoxy-D-galactopyranose, which includes both the β-form: 2-(Acetylamino)-2-deoxy-β-D-galactopyranose and α-form: 2-(Acetylamino)-2-deoxy-D-galactopyranose. In certain embodiments, both the β-form: 2-(Acetylamino)-2-deoxy-β-D-galactopyranose and α-form: 2-(Acetylamino)-2-deoxy-D-galactopyranose may be used interchangeably. Accordingly, in structures in which one form is depicted, these structures are intended to include the other form as well. For example, where the structure for an α-form: 2-(Acetylamino)-2-deoxy-D-galactopyranose is shown, this structure is intended to include the other form as well. In certain embodiments, In certain preferred embodiments, the β-form 2-(Acetylamino)-2-deoxy-D-galactopyranose is the preferred embodiment.

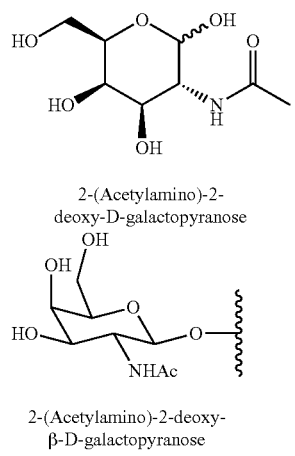

2-(Acetylamino)-2-deoxy-D-galactopyranose 2-(Acetylamino)-2-deoxy-β-D-galactopyranose

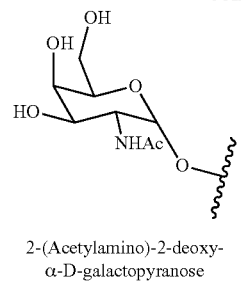

2-(Acetylamino)-2-deoxy-α-D-galactopyranose

In certain embodiments one or more ligand has a structure selected from among:

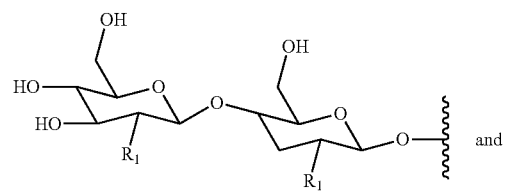

and

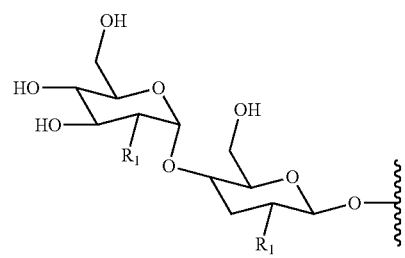

wherein each $R_1$ is selected from OH and NHCOOH.

In certain embodiments one or more ligand has a structure selected from among:

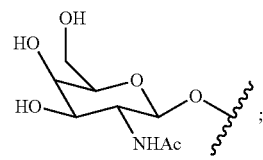

;

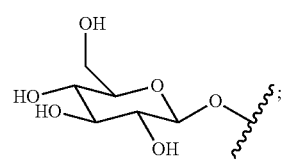

;

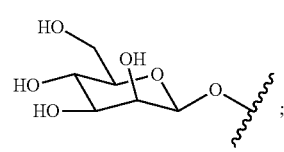

;

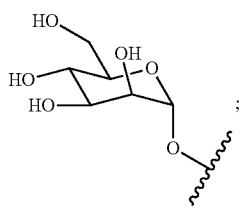

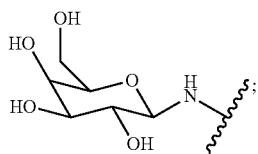

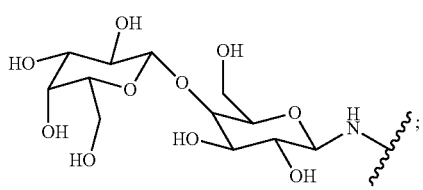

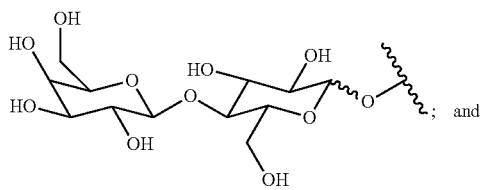
; and

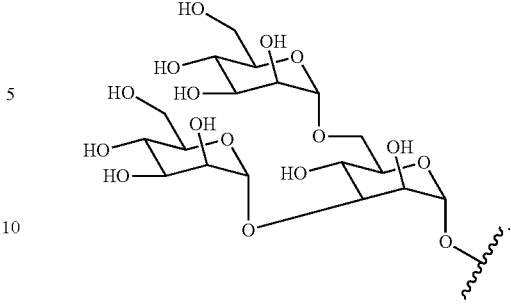

In certain embodiments one or more ligand has a structure selected from among:

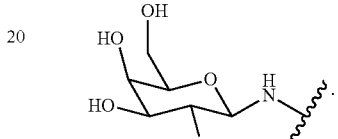

In certain embodiments one or more ligand has a structure selected from among:

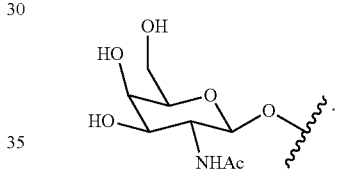

i. Certain Conjugates

In certain embodiments, conjugate groups comprise the structural features above. In certain such embodiments, conjugate groups have the following structure:

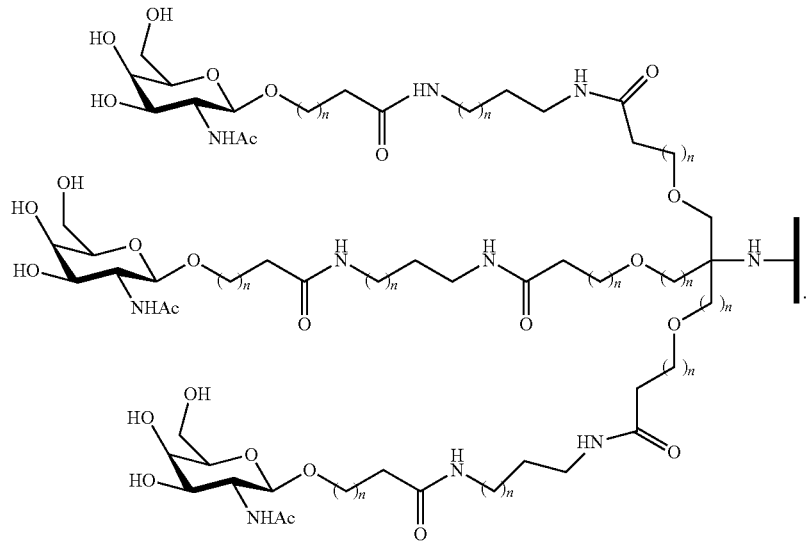

wherein each n is, independently, from 1 to 20.

In certain such embodiments, conjugate groups have the following structure:
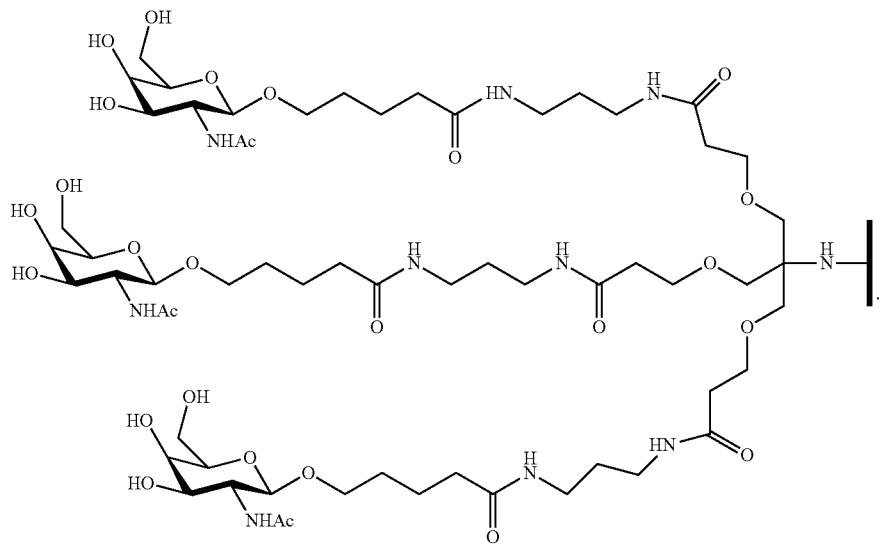
In certain such embodiments, conjugate groups have the following structure:
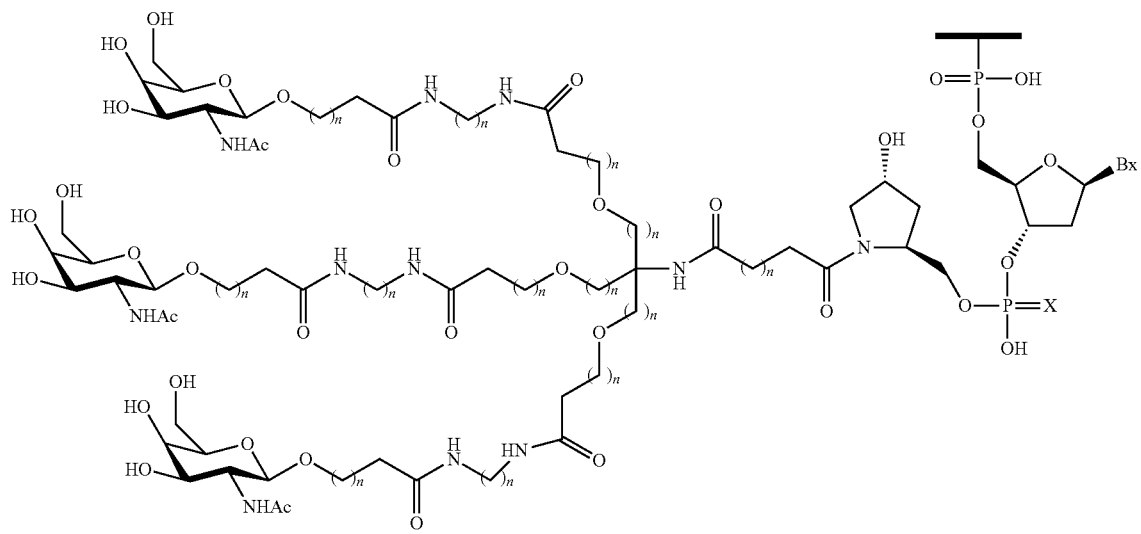
wherein each n is, independently, from 1 to 20;
Z is H or a linked solid support;
Q is an antisense compound;
X is O or S; and
Bx is a heterocyclic base moiety.

In certain such embodiments, conjugate groups have the following structure:
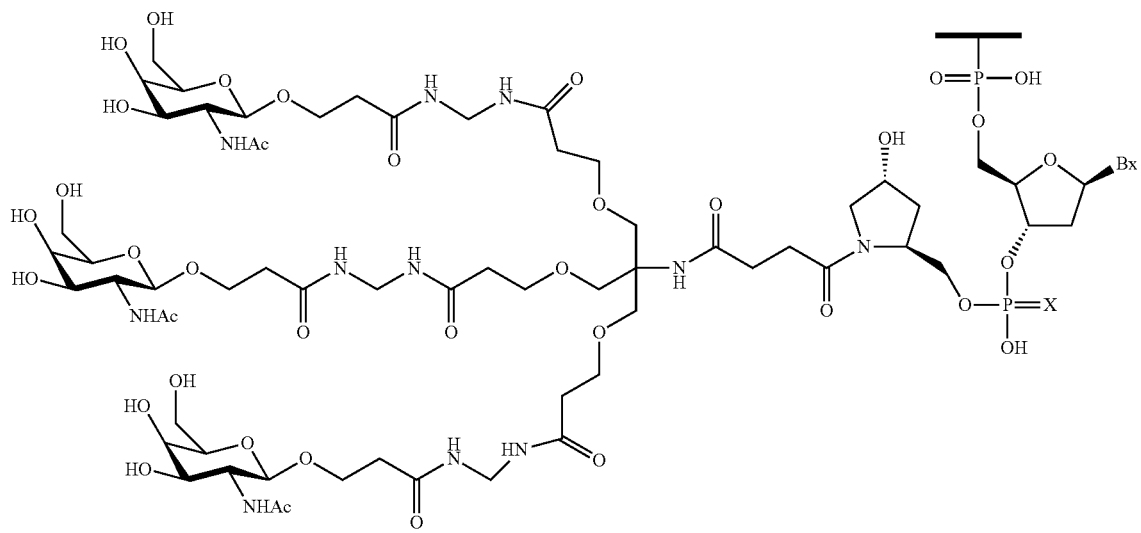
In certain such embodiments, conjugate groups have the following structure:
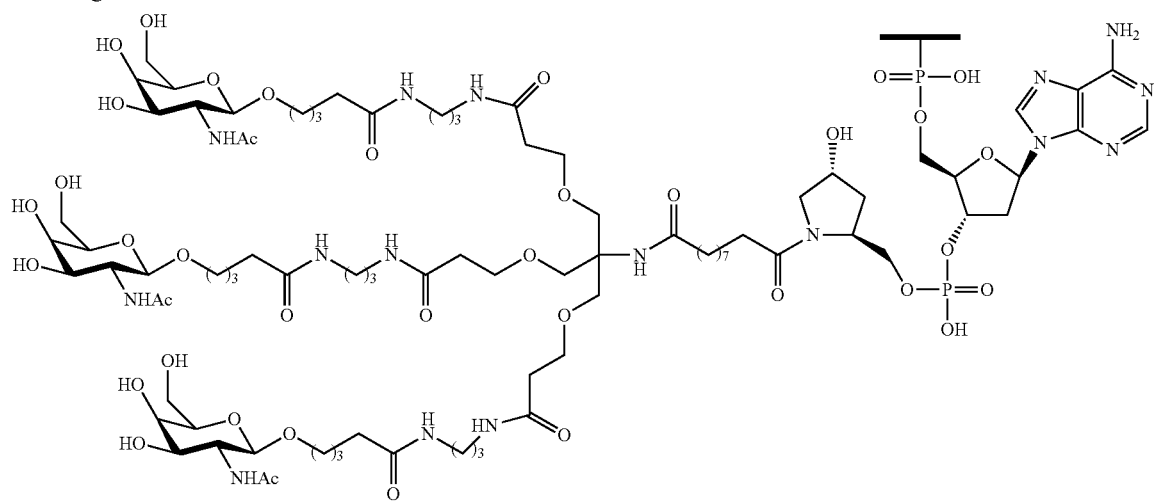
In certain such embodiments, conjugate groups have the following structure:
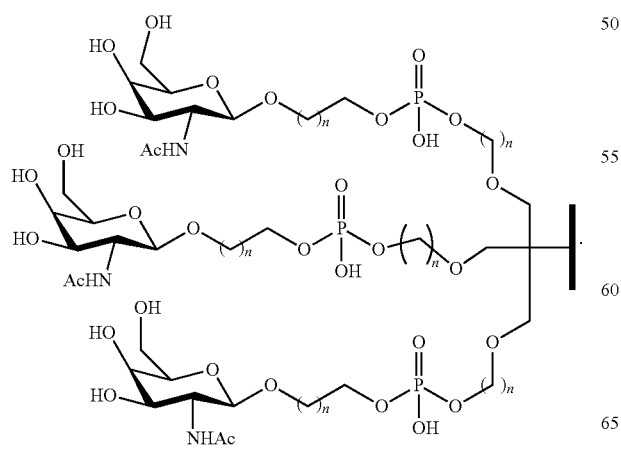

In certain such embodiments, conjugate groups have the following structure:
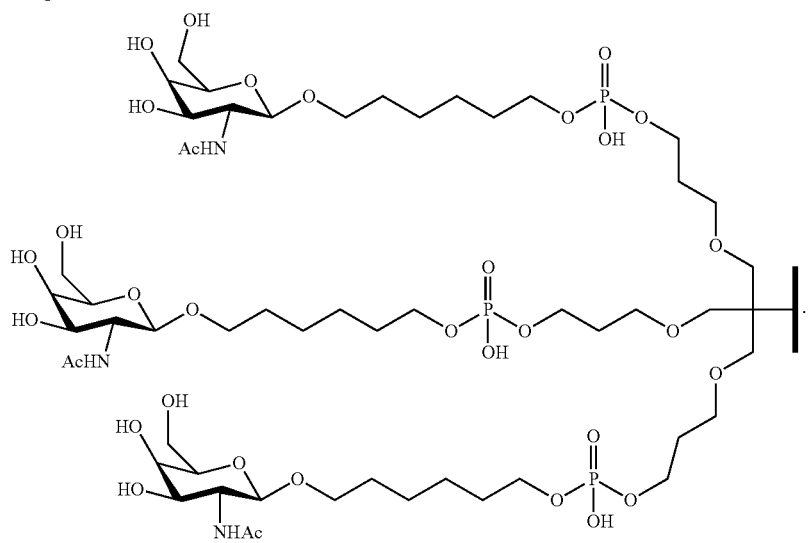
In certain such embodiments, conjugate groups have the following structure:
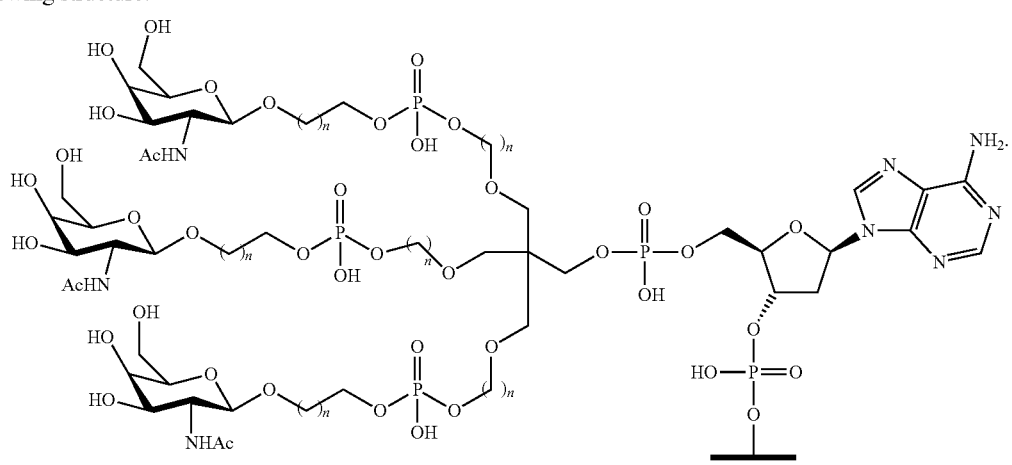
In certain such embodiments, conjugate groups have the following structure:
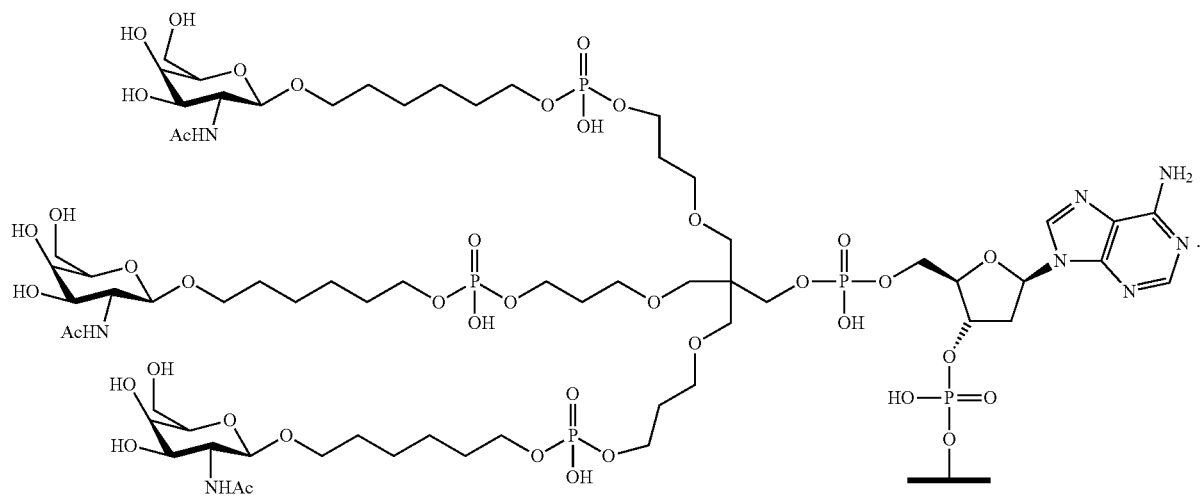

In certain such embodiments, conjugate groups have the following structure:
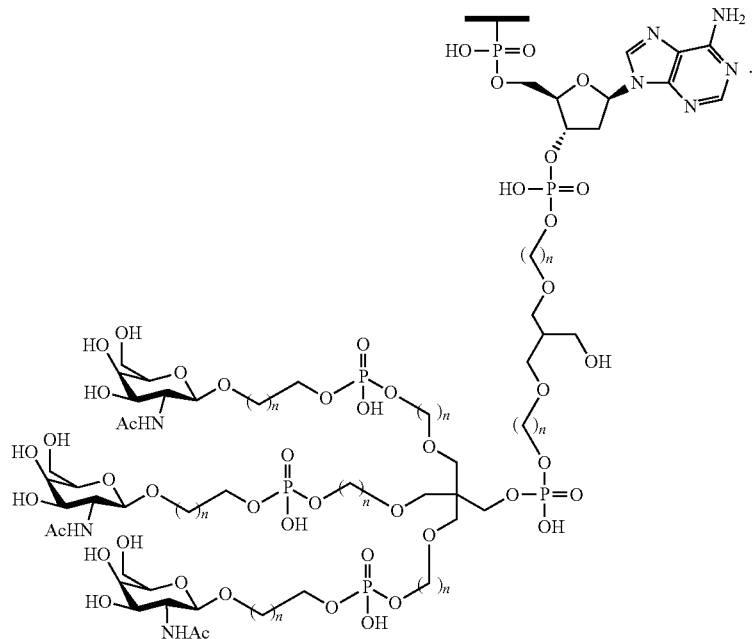
In certain such embodiments, conjugate groups have the following structure:
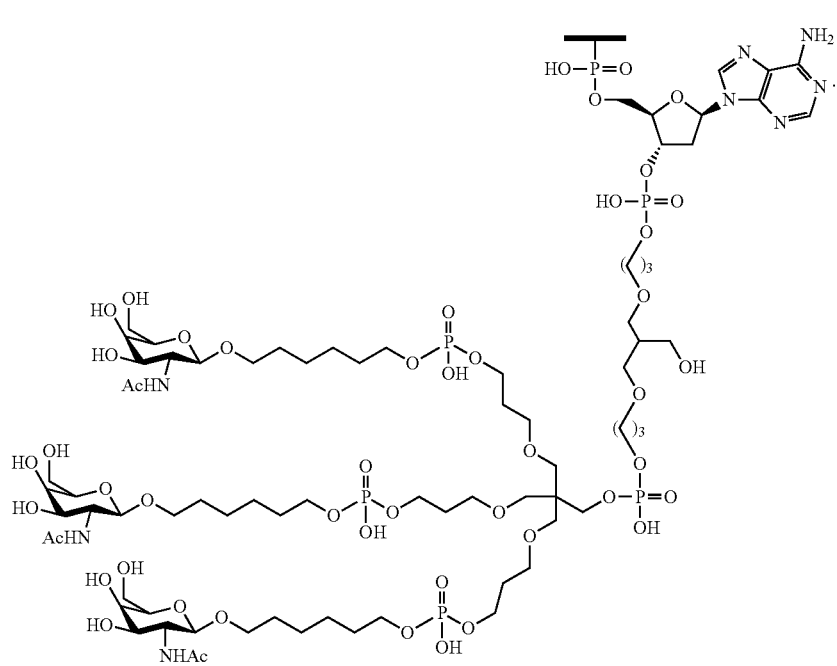
In certain embodiments, conjugates do not comprise a pyrrolidine.

In certain such embodiments, conjugate groups have the following structure:
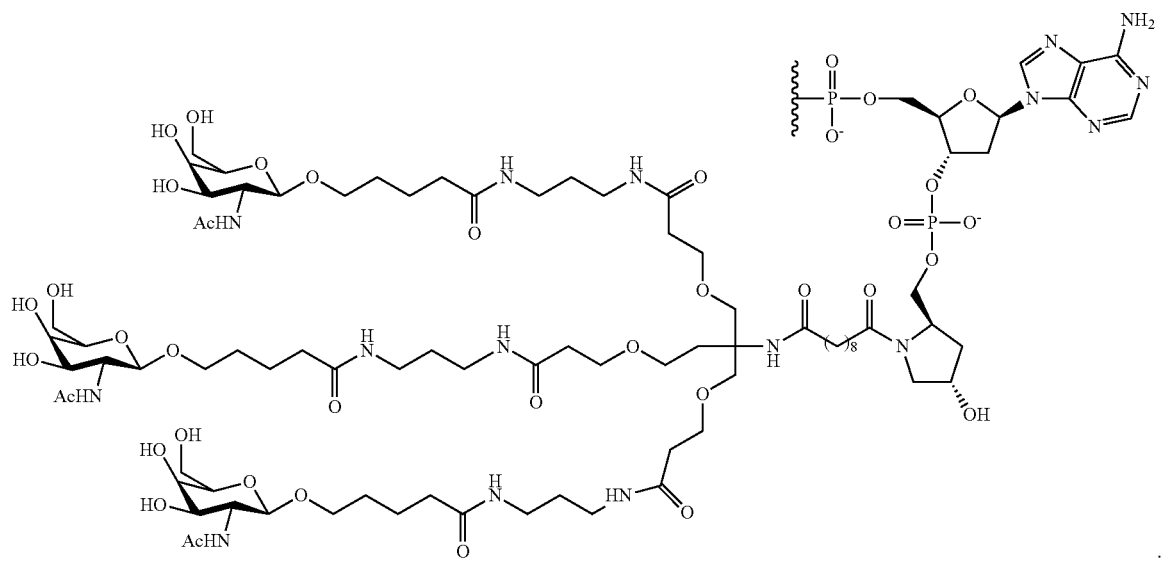
In certain such embodiments, conjugate groups have the following structure:
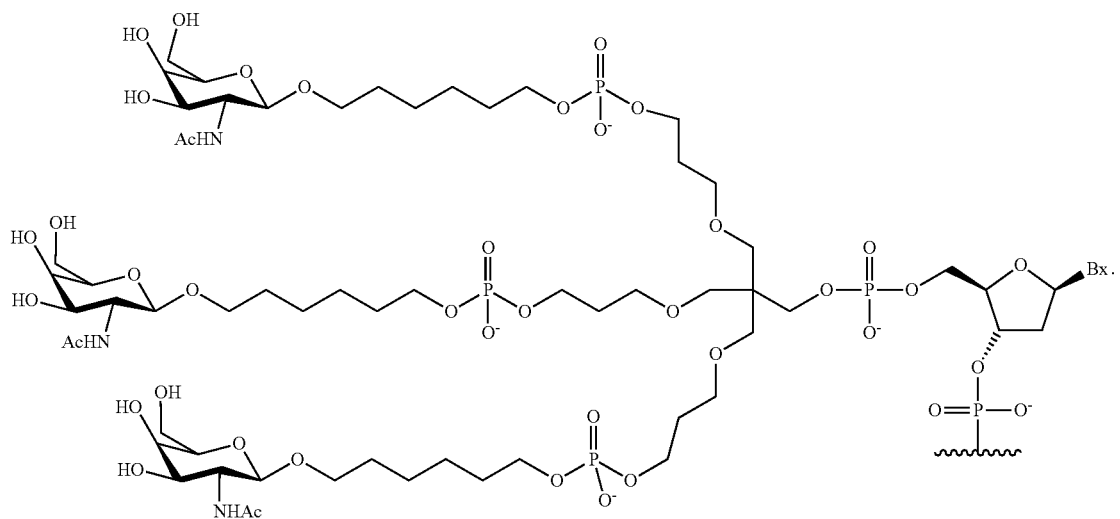

In certain such embodiments, conjugate groups have the following structure:
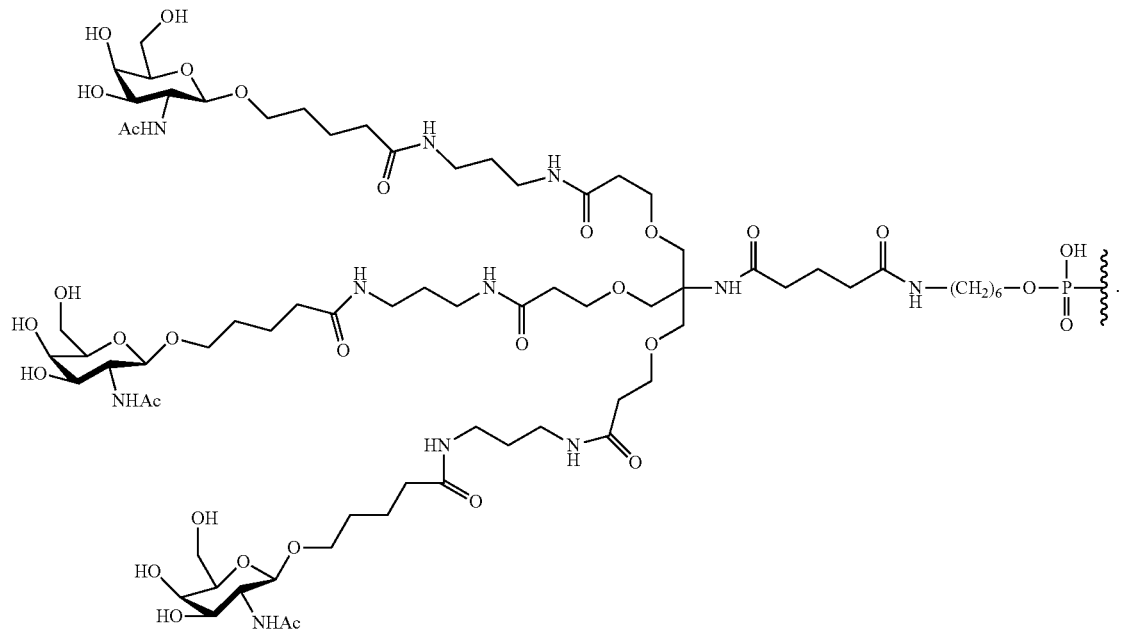
In certain such embodiments, conjugate groups have the following structure:
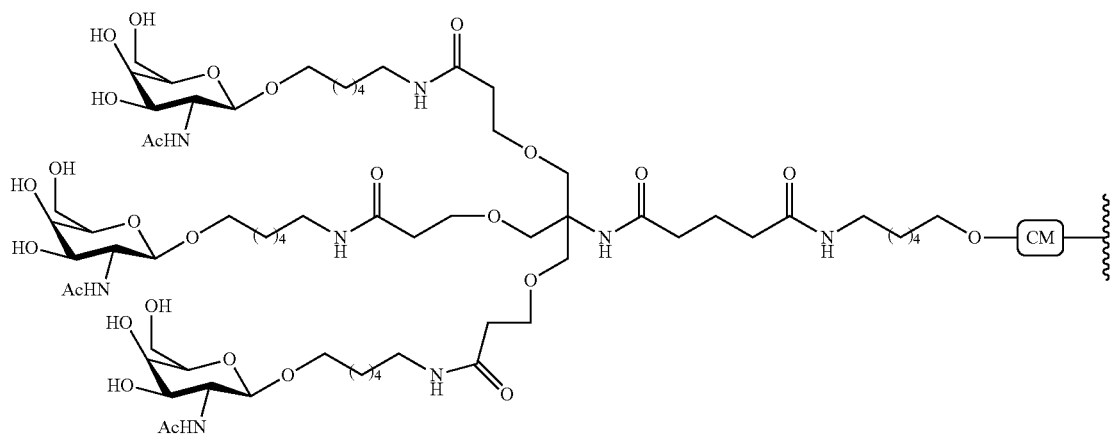

In certain such embodiments, conjugate groups have the following structure:
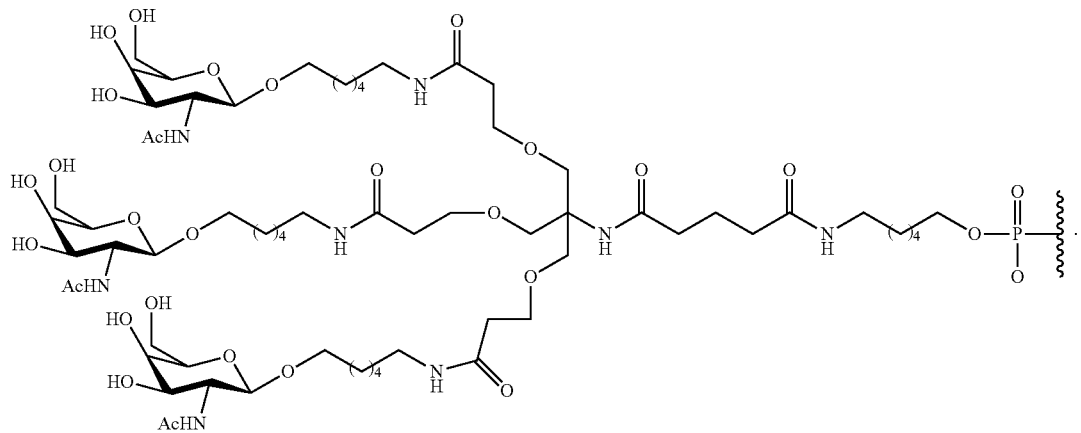
In certain such embodiments, conjugate groups have the following structure:
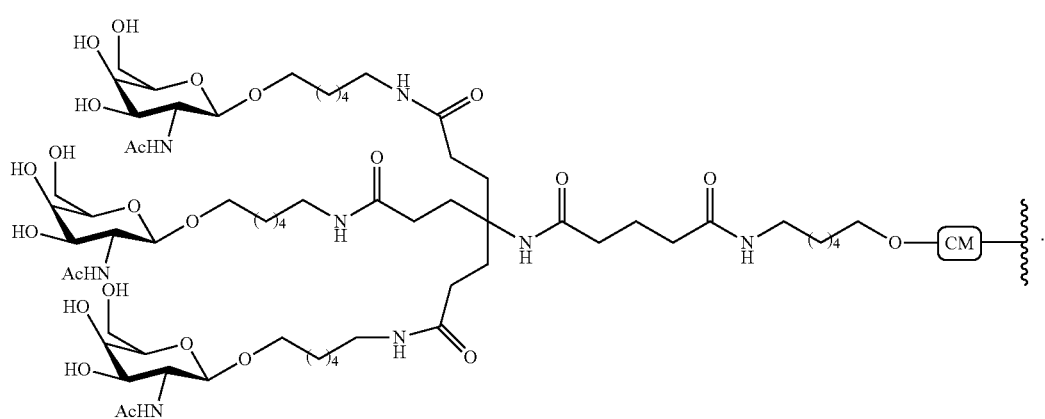
In certain such embodiments, conjugate groups have the following structure:
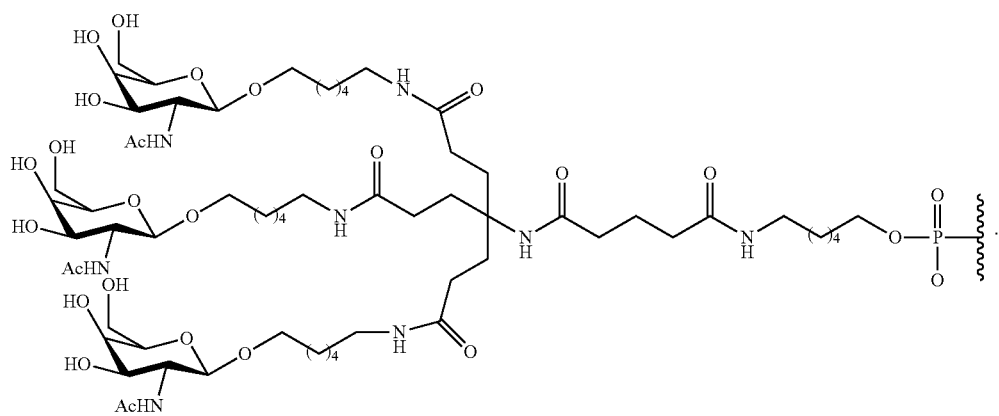

In certain such embodiments, conjugate groups have the following structure:
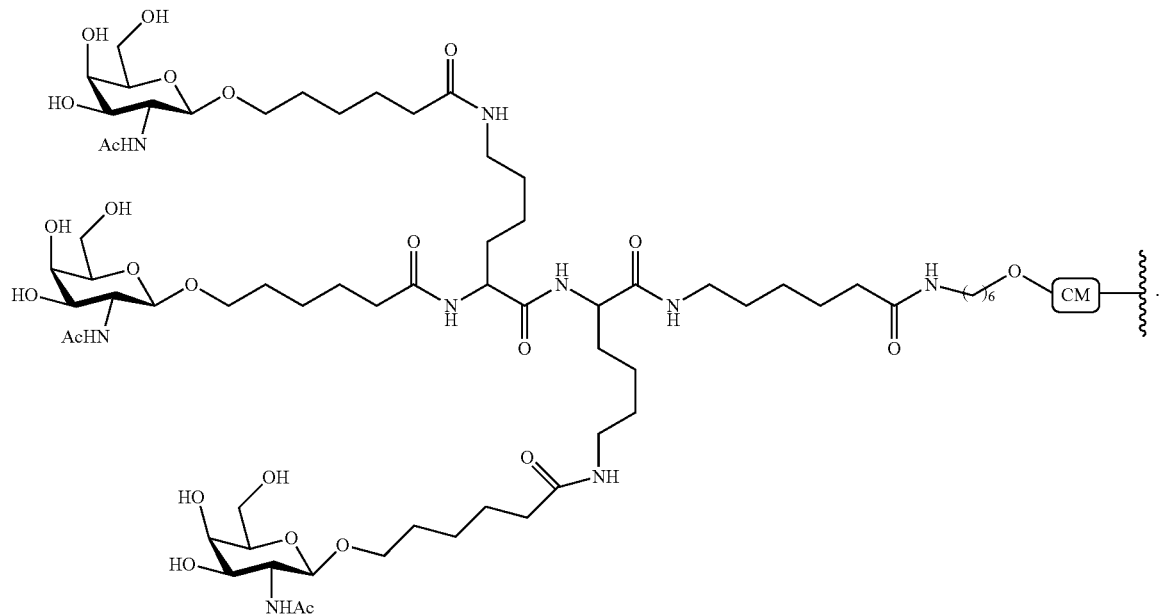
In certain such embodiments, conjugate groups have the following structure:
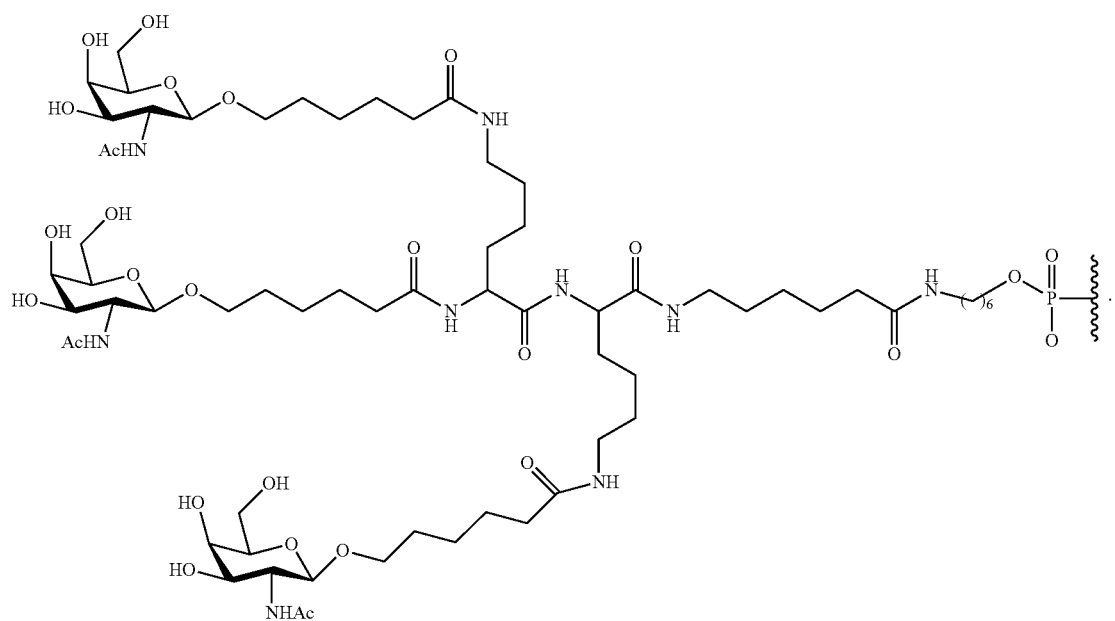

In certain such embodiments, conjugate groups have the following structure:

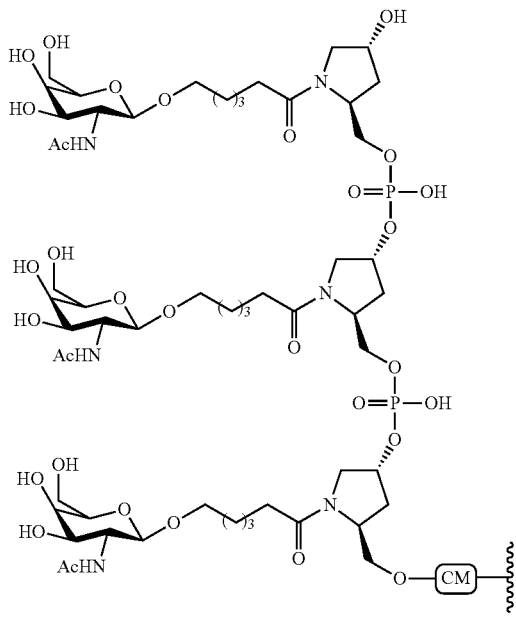

In certain such embodiments, conjugate groups have the following structure:

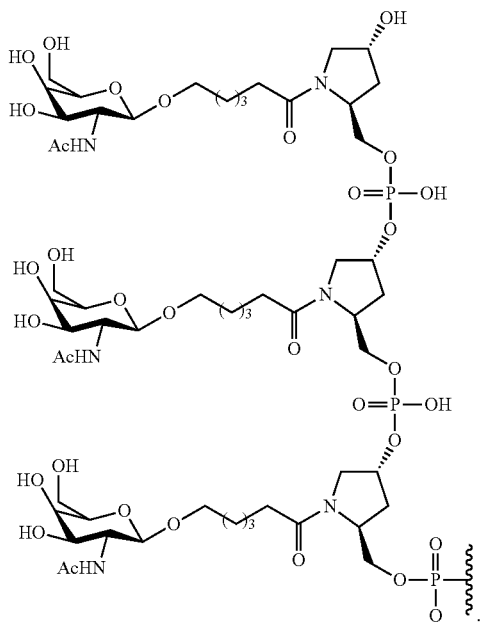

In certain embodiments, the cell-targeting moiety of the conjugate group has the following structure:

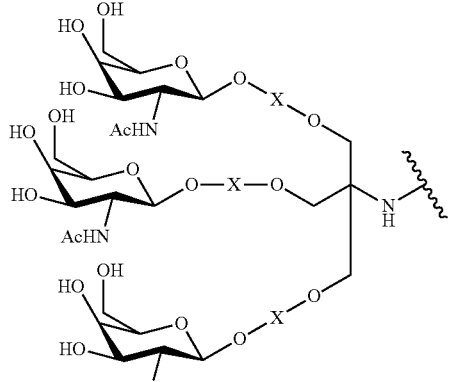

wherein X is a substituted or unsubstituted tether of six to eleven consecutively bonded atoms.

In certain embodiments, the cell-targeting moiety of the conjugate group has the following structure:

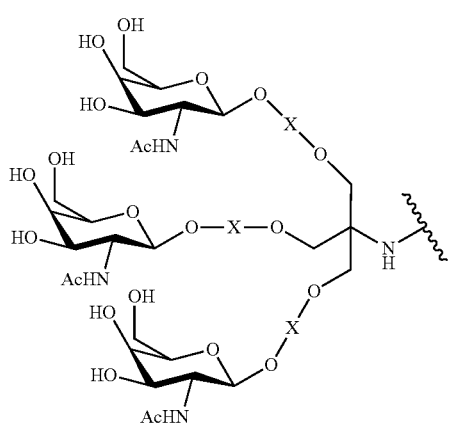

wherein X is a substituted or unsubstituted tether of ten consecutively bonded atoms.

In certain embodiments, the cell-targeting moiety of the conjugate group has the following structure:

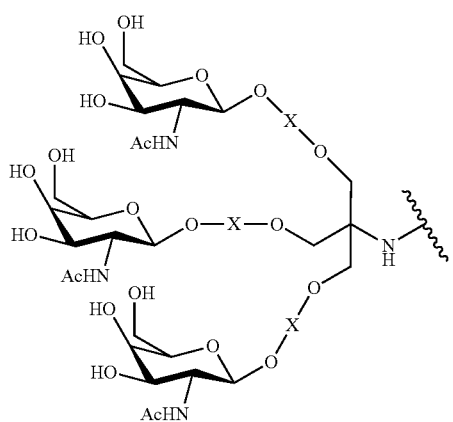

wherein X is a substituted or unsubstituted tether of four to eleven consecutively bonded atoms and wherein the tether comprises exactly one amide bond.

In certain embodiments, the cell-targeting moiety of the conjugate group has the following structure:

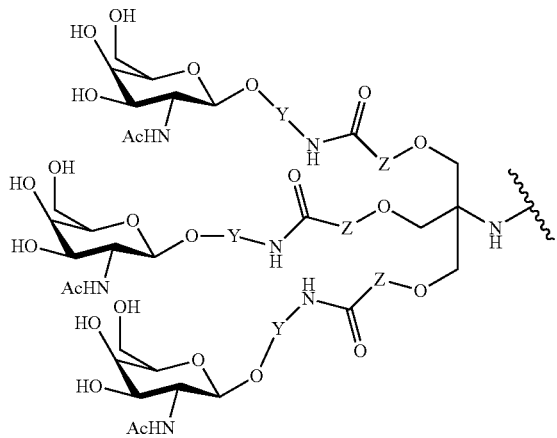

wherein Y and Z are independently selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

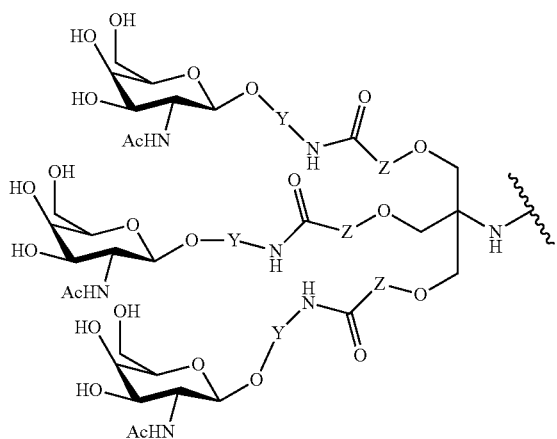

wherein Y and Z are independently selected from a $C_1$-$C_{12}$ substituted or unsubstituted alkyl group, or a group comprising exactly one ether or exactly two ethers, an amide, an amine, a piperidine, a phosphate, a phosphodiester, or a phosphorothioate.

In certain such embodiments, the cell-targeting moiety of the conjugate group has the following structure:

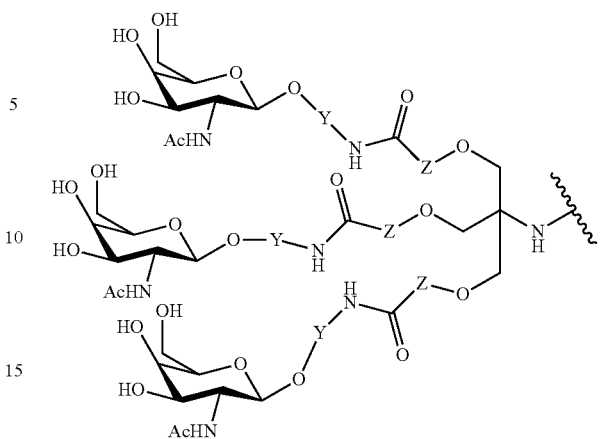

wherein Y and Z are independently selected from a $C_1$-$C_{12}$ substituted or unsubstituted alkyl group.

In certain such embodiments, the cell-targeting moiety of the conjugate group has the following structure:

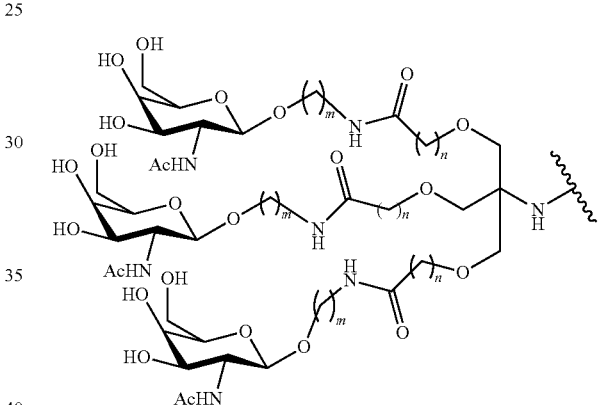

wherein m and n are independently selected from 1, 2, 3, 4, 5, 6, 7, 8, 9, 10, 11, and 12.

In certain such embodiments, the cell-targeting moiety of the conjugate group has the following structure:

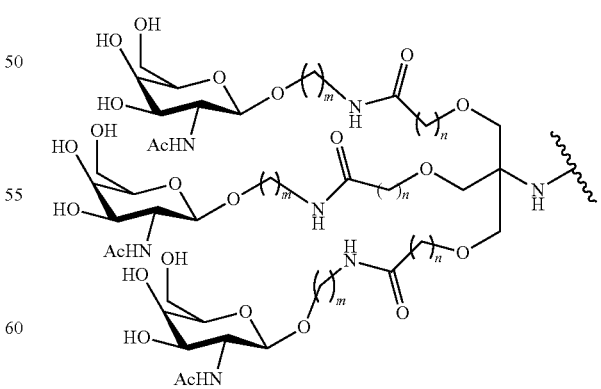

wherein m is 4, 5, 6, 7, or 8, and n is 1, 2, 3, or 4.

In certain embodiments, the cell-targeting moiety of the conjugate group has the following structure:

611

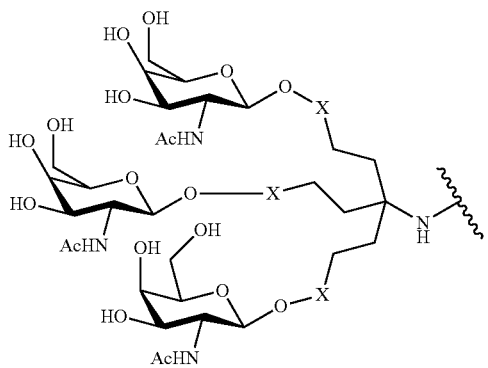

wherein X is a substituted or unsubstituted tether of four to thirteen consecutively bonded atoms, and wherein X does not comprise an ether group.

In certain embodiments, the cell-targeting moiety of the conjugate group has the following structure:

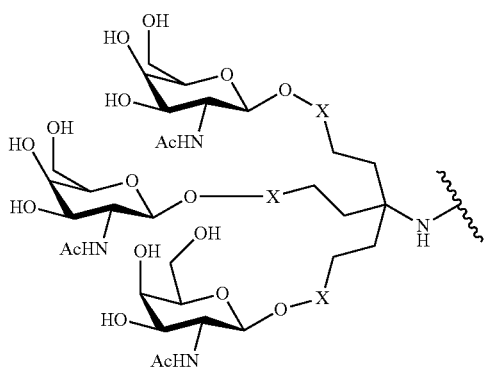

wherein X is a substituted or unsubstituted tether of eight consecutively bonded atoms, and wherein X does not comprise an ether group.

In certain embodiments, the cell-targeting moiety of the conjugate group has the following structure:

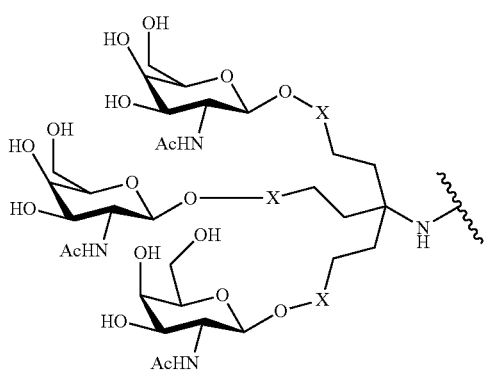

wherein X is a substituted or unsubstituted tether of four to thirteen consecutively bonded atoms, and wherein the tether comprises exactly one amide bond, and wherein X does not comprise an ether group.

In certain embodiments, the cell-targeting moiety of the conjugate group has the following structure:

612

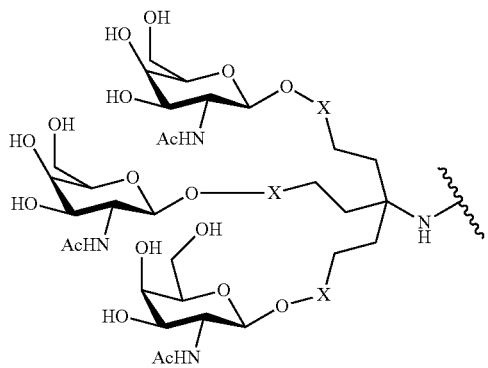

wherein X is a substituted or unsubstituted tether of four to thirteen consecutively bonded atoms and wherein the tether consists of an amide bond and a substituted or unsubstituted $C_2$-$C_{11}$ alkyl group.

In certain embodiments, the cell-targeting moiety of the conjugate group has the following structure:

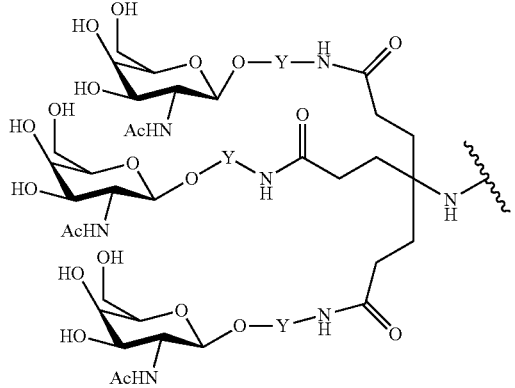

wherein Y is selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

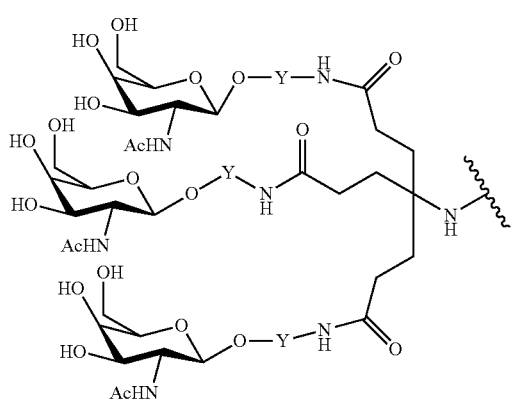

wherein Y is selected from a $C_1$-$C_{12}$ substituted or unsubstituted alkyl group, or a group comprising an ether, an amine, a piperidine, a phosphate, a phosphodiester, or a phosphorothioate.

In certain such embodiments, the cell-targeting moiety of the conjugate group has the following structure:

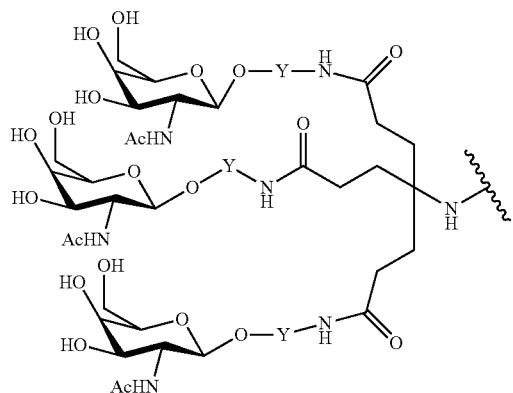

wherein Y is selected from a $C_1$-$C_{12}$ substituted or unsubstituted alkyl group.

In certain such embodiments, the cell-targeting moiety of the conjugate group has the following structure:

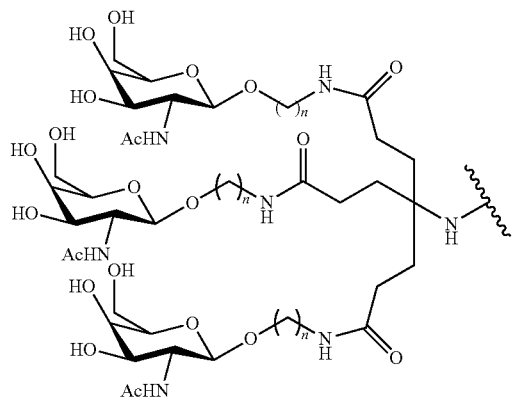

Wherein n is 1, 2, 3, 4, 5, 6, 7, 8, 9, 10, 11, or 12.

In certain such embodiments, the cell-targeting moiety of the conjugate group has the following structure:

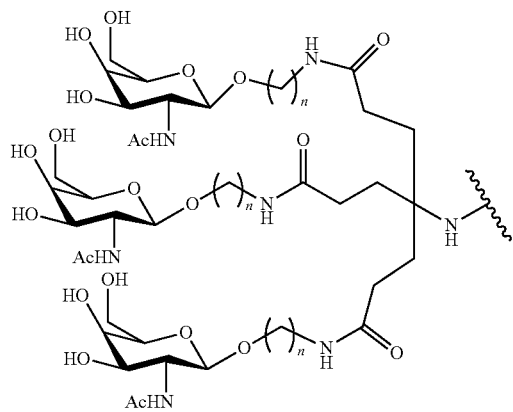

wherein n is 4, 5, 6, 7, or 8.

b. Certain Conjugated Antisense Compounds

In certain embodiments, the conjugates are bound to a nucleoside of the antisense oligonucleotide at the 2', 3', of 5' position of the nucleoside. In certain embodiments, a conjugated antisense compound has the following structure:

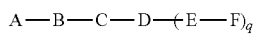

wherein
A is the antisense oligonucleotide;
B is the cleavable moiety
C is the conjugate linker
D is the branching group
each E is a tether;
each F is a ligand; and
q is an integer between 1 and 5.

In certain embodiments, a conjugated antisense compound has the following structure:

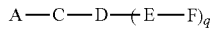

wherein
A is the antisense oligonucleotide;
C is the conjugate linker
D is the branching group
each E is a tether;
each F is a ligand; and
q is an integer between 1 and 5.

In certain such embodiments, the conjugate linker comprises at least one cleavable bond.

In certain such embodiments, the branching group comprises at least one cleavable bond.

In certain embodiments each tether comprises at least one cleavable bond.

In certain embodiments, the conjugates are bound to a nucleoside of the antisense oligonucleotide at the 2', 3', of 5' position of the nucleoside.

In certain embodiments, a conjugated antisense compound has the following structure:

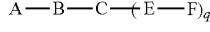

wherein
A is the antisense oligonucleotide;
B is the cleavable moiety
C is the conjugate linker
each E is a tether;
each F is a ligand; and
q is an integer between 1 and 5.

In certain embodiments, the conjugates are bound to a nucleoside of the antisense oligonucleotide at the 2', 3', of 5' position of the nucleoside. In certain embodiments, a conjugated antisense compound has the following structure:

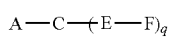

wherein
A is the antisense oligonucleotide;
C is the conjugate linker
each E is a tether;

each F is a ligand; and
q is an integer between 1 and 5.

In certain embodiments, a conjugated antisense compound has the following structure:

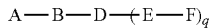

wherein
A is the antisense oligonucleotide;
B is the cleavable moiety
D is the branching group each E is a tether;
each F is a ligand; and
q is an integer between 1 and 5.

In certain embodiments, a conjugated antisense compound has the following structure:

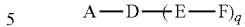

wherein
A is the antisense oligonucleotide;
D is the branching group each E is a tether;
each F is a ligand; and
q is an integer between 1 and 5.

In certain such embodiments, the conjugate linker comprises at least one cleavable bond.

In certain embodiments each tether comprises at least one cleavable bond.

In certain embodiments, a conjugated antisense compound has a structure selected from among the following:

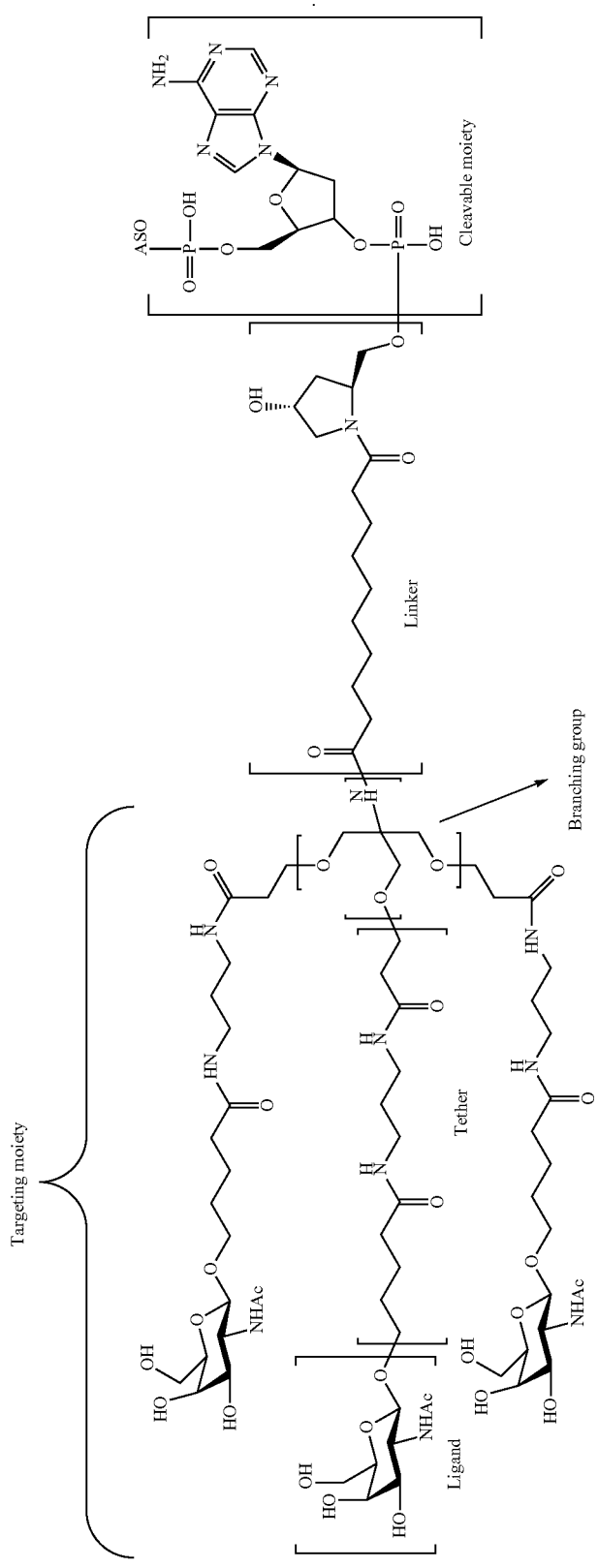

In certain embodiments, a conjugated antisense compound has a structure selected from among the following:
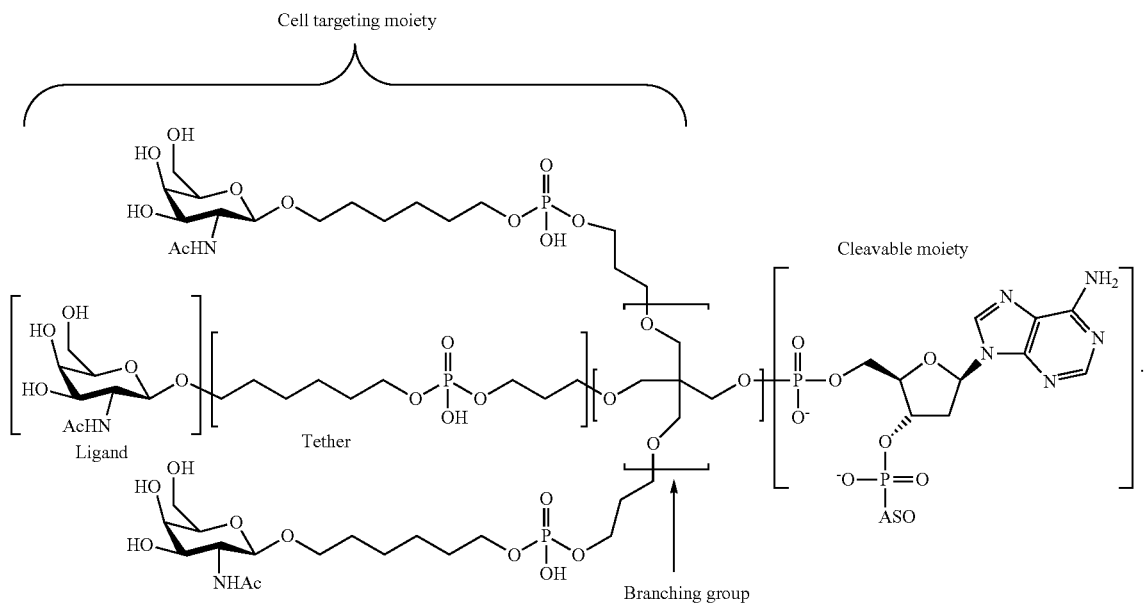
In certain embodiments, a conjugated antisense compound has a structure selected from among the following:
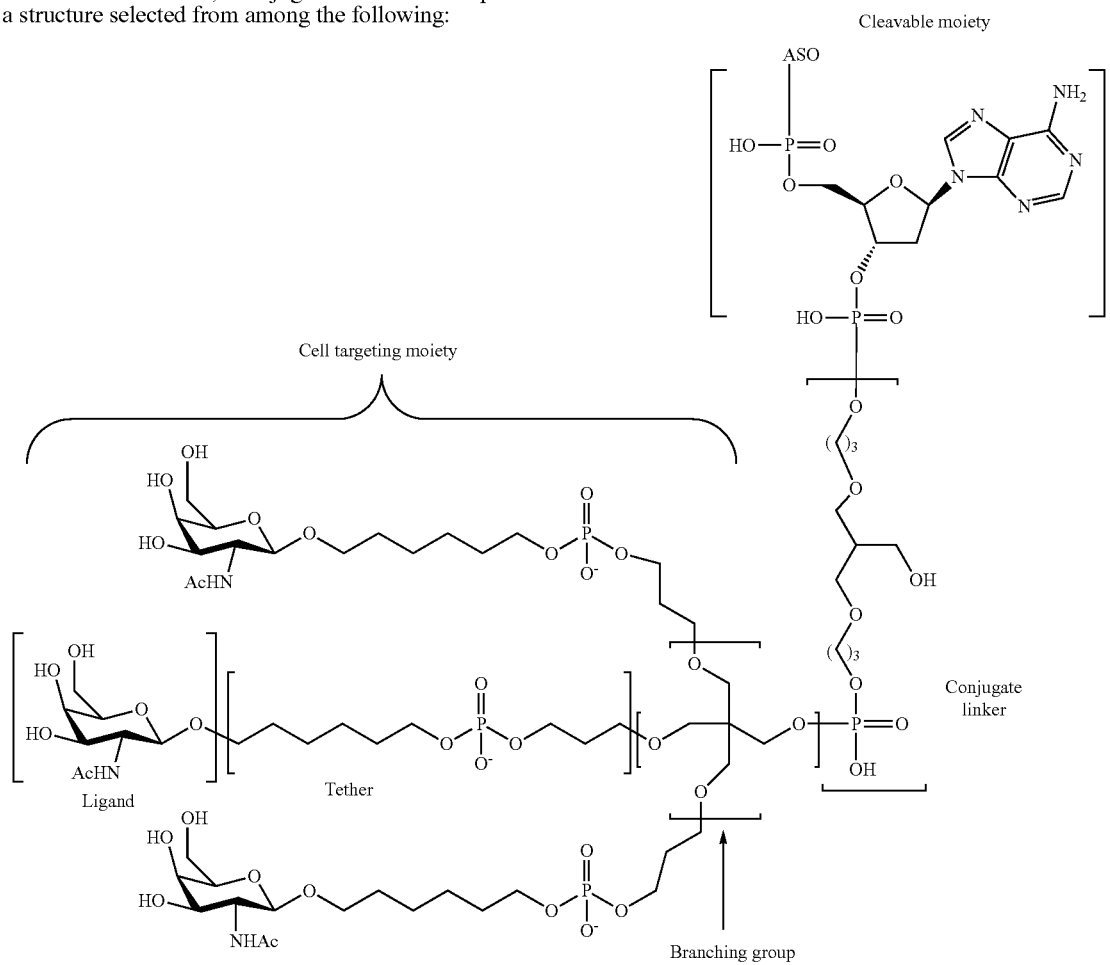
In certain embodiments, the conjugated antisense compound has the following structure:

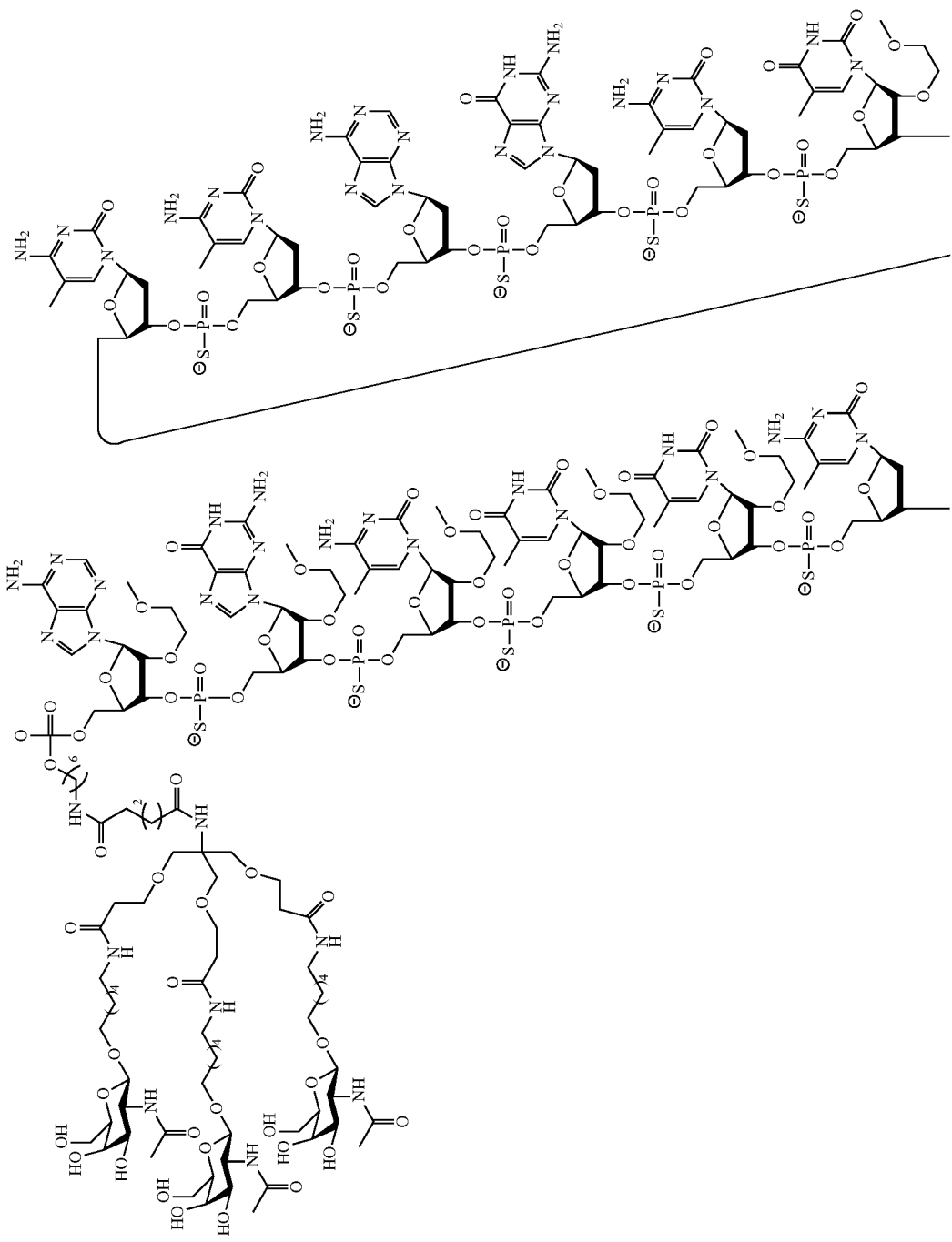

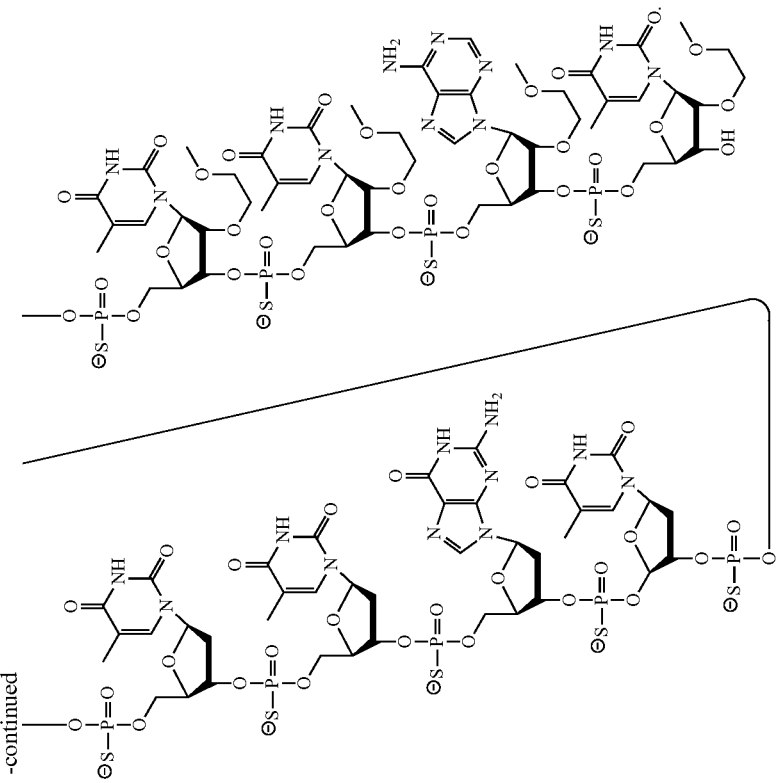

Representative United States patents, United States patent application publications, and international patent application publications that teach the preparation of certain of the above noted conjugates, conjugated antisense compounds, tethers, linkers, branching groups, ligands, cleavable moieties as well as other modifications include without limitation, U.S. Pat. No. 5,994,517, U.S. Pat. No. 6,300,319, U.S. Pat. No. 6,660,720, U.S. Pat. No. 6,906,182, U.S. Pat. No. 7,262,177, U.S. Pat. No. 7,491,805, U.S. Pat. No. 8,106,022, U.S. Pat. No. 7,723,509, US 2006/0148740, US 2011/0123520, WO 2013/033230 and WO 2012/037254, each of which is incorporated by reference herein in its entirety.

Representative publications that teach the preparation of certain of the above noted conjugates, conjugated antisense compounds, tethers, linkers, branching groups, ligands, cleavable moieties as well as other modifications include without limitation, BIESSEN et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852, BIESSEN et al., "Synthesis of Cluster Galactosides with High Affinity for the Hepatic Asialoglycoprotein Receptor" J. Med. Chem. (1995) 38:1538-1546, LEE et al., "New and more efficient multivalent glyco-ligands for asialoglycoprotein receptor of mammalian hepatocytes" Bioorganic & Medicinal Chemistry (2011) 19:2494-2500, RENSEN et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584, RENSEN et al., "Design and Synthesis of Novel N-Acetylgalactosamine-Terminated Glycolipids for Targeting of Lipoproteins to the Hepatic Asialoglycoprotein Receptor" J. Med. Chem. (2004) 47:5798-5808, SLIEDREGT et al., "Design and Synthesis of Novel Amphiphilic Dendritic Galactosides for Selective Targeting of Liposomes to the Hepatic Asialoglycoprotein Receptor" J. Med. Chem. (1999) 42:609-618, and Valentijn et al., "Solid-phase synthesis of lysine-based cluster galactosides with high affinity for the Asialoglycoprotein Receptor" Tetrahedron, 1997, 53(2), 759-770, each of which is incorporated by reference herein in its entirety.

In certain embodiments, conjugated antisense compounds comprise an RNase H based oligonucleotide (such as a gapmer) or a splice modulating oligonucleotide (such as a fully modified oligonucleotide) and any conjugate group comprising at least one, two, or three GalNAc groups. In certain embodiments a conjugated antisense compound comprises any conjugate group found in any of the following references: Lee, Carbohydr Res, 1978, 67, 509-514; Connolly et al., J Biol Chem, 1982, 257, 939-945; Pavia et al., Int J Pep Protein Res, 1983, 22, 539-548; Lee et al., Biochem, 1984, 23, 4255-4261; Lee et al., Glycoconjugate J, 1987, 4, 317-328; Toyokuni et al., Tetrahedron Lett, 1990, 31, 2673-2676; Biessen et al., J Med Chem, 1995, 38, 1538-1546; Valentijn et al., Tetrahedron, 1997, 53, 759-770; Kim et al., Tetrahedron Lett, 1997, 38, 3487-3490; Lee et al., Bioconjug Chem, 1997, 8, 762-765; Kato et al., Glycobiol, 2001, 11, 821-829; Rensen et al., J Biol Chem, 2001, 276, 37577-37584; Lee et al., Methods Enzymol, 2003, 362, 38-43; Westerlind et al., Glycoconj J, 2004, 21, 227-241; Lee et al., Bioorg Med Chem Lett, 2006, 16(19), 5132-5135; Maierhofer et al., Bioorg Med Chem, 2007, 15, 7661-7676; Khorev et al., Bioorg Med Chem, 2008, 16, 5216-5231; Lee et al., Bioorg Med Chem, 2011, 19, 2494-2500; Kornilova et al., Analyt Biochem, 2012, 425, 43-46; Pujol et al., Angew Chemie Int Ed Engl, 2012, 51, 7445-7448; Biessen et al., J Med Chem, 1995, 38, 1846-1852; Sliedregt et al., J Med Chem, 1999, 42, 609-618; Rensen et al., J Med Chem, 2004, 47, 5798-5808; Rensen et al., Arterioscler Thromb Vasc Biol, 2006, 26, 169-175; van Rossenberg et al., Gene Ther, 2004, 11, 457-464; Sato et al., J Am Chem Soc, 2004, 126, 14013-14022; Lee et al., J Org Chem, 2012, 77, 7564-7571; Biessen et al., FASEB J, 2000, 14, 1784-1792; Rajur et al., Bioconjug Chem, 1997, 8, 935-940; Duff et al., Methods Enzymol, 2000, 313, 297-321; Maier et al., Bioconjug Chem, 2003, 14, 18-29; Jayaprakash et al., Org Lett, 2010, 12, 5410-5413; Manoharan, Antisense Nucleic Acid Drug Dev, 2002, 12, 103-128; Merwin et al., Bioconjug Chem, 1994, 5, 612-620; Tomiya et al., Bioorg Med Chem, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132; each of which is incorporated by reference in its entirety.

C. Certain Uses and Features

In certain embodiments, conjugated antisense compounds exhibit potent target RNA reduction in vivo. In certain embodiments, unconjugated antisense compounds accumulate in the kidney. In certain embodiments, conjugated antisense compounds accumulate in the liver. In certain embodiments, conjugated antisense compounds are well tolerated. Such properties render conjugated antisense compounds particularly useful for inhibition of many target RNAs, including, but not limited to those involved in metabolic, cardiovascular and other diseases, disorders or conditions. Thus, provided herein are methods of treating such diseases, disorders or conditions by contacting liver tissues with the conjugated antisense compounds targeted to RNAs associated with such diseases, disorders or conditions. Thus, also provided are methods for ameliorating any of a variety of metabolic, cardiovascular and other diseases, disorders or conditions with the conjugated antisense compounds of the present invention.

In certain embodiments, conjugated antisense compounds are more potent than unconjugated counterpart at a particular tissue concentration. Without wishing to be bound by any theory or mechanism, in certain embodiments, the conjugate may allow the conjugated antisense compound to enter the cell more efficiently or to enter the cell more productively. For example, in certain embodiments conjugated antisense compounds may exhibit greater target reduction as compared to its unconjugated counterpart wherein both the conjugated antisense compound and its unconjugated counterpart are present in the tissue at the same concentrations. For example, in certain embodiments conjugated antisense compounds may exhibit greater target reduction as compared to its unconjugated counterpart wherein both the conjugated antisense compound and its unconjugated counterpart are present in the liver at the same concentrations.

Productive and non-productive uptake of oligonucleotides has been discussed previously (See e.g. Geary, R. S., E. Wancewicz, et al. (2009). "Effect of Dose and Plasma Concentration on Liver Uptake and Pharmacologic Activity of a 2'-Methoxyethyl Modified Chimeric Antisense Oligonucleotide Targeting PTEN." Biochem. Pharmacol. 78(3): 284-91; & Koller, E., T. M. Vincent, et al. (2011). "Mechanisms of single-stranded phosphorothioate modified antisense oligonucleotide accumulation in hepatocytes." Nucleic Acids Res. 39(11): 4795-807). Conjugate groups described herein may improve productive uptake.

In certain embodiments, the conjugate groups described herein may further improve potency by increasing the affinity of the conjugated antisense compound for a particular type of cell or tissue. In certain embodiments, the conjugate groups described herein may further improve potency by increasing recognition of the conjugated antisense compound by one or more cell-surface receptors. In certain embodiments, the conjugate groups described herein may further improve potency by facilitating endocytosis of the conjugated antisense compound.

In certain embodiments, the cleavable moiety may further improve potency by allowing the conjugate to be cleaved from the antisense oligonucleotide after the conjugated antisense compound has entered the cell. Accordingly, in certain embodiments, conjugated antisense compounds can be administered at doses lower than would be necessary for unconjugated antisense oligonucleotides.

Phosphorothioate linkages have been incorporated into antisense oligonucleotides previously. Such phosphorothioate linkages are resistant to nucleases and so improve stability of the oligonucleotide. Further, phosphorothioate linkages also bind certain proteins, which results in accumulation of antisense oligonucleotide in the liver. Oligonucleotides with fewer phosphorothioate linkages accumulate less in the liver and more in the kidney (see, for example, Geary, R., "Pharmacokinetic Properties of 2'-O-(2-Methoxyethyl)-Modified Oligonucleotide Analogs in Rats," *Journal of Pharmacology and Experimental Therapeutics*, Vol. 296, No. 3, 890-897; & *Pharmacological Properties of 2'-O-Methoxyethyl Modified Oligonucleotides* in Antisense a Drug Technology, Chapter 10, Crooke, S. T., ed., 2008) In certain embodiments, oligonucleotides with fewer phosphorothioate internucleoside linkages and more phosphodiester internucleoside linkages accumulate less in the liver and more in the kidney. When treating diseases in the liver, this is undesirable for several reasons (1) less drug is getting to the site of desired action (liver); (2) drug is escaping into the urine; and (3) the kidney is exposed to relatively high concentration of drug which can result in toxicities in the kidney. Thus, for liver diseases, phosphorothioate linkages provide important benefits.

In certain embodiments, however, administration of oligonucleotides uniformly linked by phosphorothioate internucleoside linkages induces one or more proinflammatory reactions. (see for example: *J Lab Clin Med.* 1996 September; 128(3):329-38. "Amplification of antibody production by phosphorothioate oligodeoxynucleotides". Branda et al.; and see also for example: *Toxicologic Properties* in Antisense a Drug Technology, Chapter 12, pages 342-351, Crooke, S. T., ed., 2008). In certain embodiments, administration of oligonucleotides wherein most of the internucleoside linkages comprise phosphorothioate internucleoside linkages induces one or more proinflammatory reactions.

In certain embodiments, the degree of proinflammatory effect may depend on several variables (e.g. backbone modification, off-target effects, nucleobase modifications, and/or nucleoside modifications) see for example: *Toxicologic Properties* in Antisense a Drug Technology, Chapter 12, pages 342-351, Crooke, S. T., ed., 2008). In certain embodiments, the degree of proinflammatory effect may be mitigated by adjusting one or more variables. For example the degree of proinflammatory effect of a given oligonucleotide may be mitigated by replacing any number of phosphorothioate internucleoside linkages with phosphodiester internucleoside linkages and thereby reducing the total number of phosphorothioate internucleoside linkages.

In certain embodiments, it would be desirable to reduce the number of phosphorothioate linkages, if doing so could be done without losing stability and without shifting the distribution from liver to kidney. For example, in certain embodiments, the number of phosphorothioate linkages may be reduced by replacing phosphorothioate linkages with phosphodiester linkages. In such an embodiment, the antisense compound having fewer phosphorothioate linkages and more phosphodiester linkages may induce less proinflammatory reactions or no proinflammatory reaction. Although the antisense compound having fewer phosphorothioate linkages and more phosphodiester linkages may induce fewer proinflammatory reactions, the antisense compound having fewer phosphorothioate linkages and more phosphodiester linkages may not accumulate in the liver and may be less efficacious at the same or similar dose as compared to an antisense compound having more phosphorothioate linkages. In certain embodiments, it is therefore desirable to design an antisense compound that has a plurality of phosphodiester bonds and a plurality of phosphorothioate bonds but which also possesses stability and good distribution to the liver.

In certain embodiments, conjugated antisense compounds accumulate more in the liver and less in the kidney than unconjugated counterparts, even when some of the phosphorothioate linkages are replaced with less proinflammatory phosphodiester internucleoside linkages. In certain embodiments, conjugated antisense compounds accumulate more in the liver and are not excreted as much in the urine compared to its unconjugated counterparts, even when some of the phosphorothioate linkages are replaced with less proinflammatory phosphodiester internucleoside linkages. In certain embodiments, the use of a conjugate allows one to design more potent and better tolerated antisense drugs. Indeed, in certain embodiments, conjugated antisense compounds have larger therapeutic indexes than unconjugated counterparts. This allows the conjugated antisense compound to be administered at a higher absolute dose, because there is less risk of proinflammatory response and less risk of kidney toxicity. This higher dose, allows one to dose less frequently, since the clearance (metabolism) is expected to be similar. Further, because the compound is more potent, as described above, one can allow the concentration to go lower before the next dose without losing therapeutic activity, allowing for even longer periods between dosing.

In certain embodiments, the inclusion of some phosphorothioate linkages remains desirable. For example, the terminal linkages are vulnerable to exonucleases and so in certain embodiments, those linkages are phosphorothioate or other modified linkage. Internucleoside linkages linking two deoxynucleosides are vulnerable to endonucleases and so in certain embodiments those linkages are phosphorothioate or other modified linkage. Internucleoside linkages between a modified nucleoside and a deoxynucleoside where the deoxynucleoside is on the 5' side of the linkage deoxynucleosides are vulnerable to endonucleases and so in certain embodiments those linkages are phosphorothioate or other modified linkage. Internucleoside linkages between two modified nucleosides of certain types and between a deoxynucleoside and a modified nucleoside of certain type where the modified nucleoside is at the 5' side of the linkage are sufficiently resistant to nuclease digestion, that the linkage can be phosphodiester.

In certain embodiments, the antisense oligonucleotide of a conjugated antisense compound comprises fewer than 16 phosphorothioate linkages. In certain embodiments, the antisense oligonucleotide of a conjugated antisense compound comprises fewer than 15 phosphorothioate linkages. In certain embodiments, the antisense oligonucleotide of a conjugated antisense compound comprises fewer than 14 phosphorothioate linkages. In certain embodiments, the antisense oligonucleotide of a conjugated antisense compound comprises fewer than 13 phosphorothioate linkages. In certain embodiments, the antisense oligonucleotide of a conjugated antisense compound comprises fewer than 12 phosphorothioate linkages. In certain embodiments, the antisense oligonucleotide of a conjugated antisense compound comprises fewer than 11 phosphorothioate linkages. In certain embodiments, the antisense oligonucleotide of a conjugated antisense compound comprises fewer than 10 phosphorothioate linkages. In certain embodiments, the antisense oligonucleotide of a conjugated antisense compound comprises fewer than 9 phosphorothioate linkages. In certain embodiments, the antisense oligonucleotide of a conjugated antisense compound comprises fewer than 8 phosphorothioate linkages.

In certain embodiments, antisense compounds comprising one or more conjugate group described herein has increased activity and/or potency and/or tolerability compared to a parent antisense compound lacking such one or more conjugate group. Accordingly, in certain embodiments, attachment of such conjugate groups to an oligonucleotide is desirable. Such conjugate groups may be attached at the 5'-, and/or 3'-end of an oligonucleotide. In certain instances, attachment at the 5'-end is synthetically desirable. Typically, oligonucleotides are synthesized by attachment of the 3' terminal nucleoside to a solid support and sequential coupling of nucleosides from 3' to 5' using techniques that are well known in the art. Accordingly if a conjugate group is desired at the 3'-terminus, one may (1) attach the conjugate group to the 3'-terminal nucleoside and attach that conjugated nucleoside to the solid support for subsequent preparation of the oligonucleotide or (2) attach the conjugate group to the 3'-terminal nucleoside of a completed oligonucleotide after synthesis. Neither of these approaches is very efficient and thus both are costly. In particular, attachment of the conjugated nucleoside to the solid support, while demonstrated in the Examples herein, is an inefficient process. In certain embodiments, attaching a conjugate group to the 5'-terminal nucleoside is synthetically easier than attachment at the 3'-end. One may attach a non-conjugated 3' terminal nucleoside to the solid support and prepare the oligonucleotide using standard and well characterized reactions. One then needs only to attach a 5' nucleoside having a conjugate group at the final coupling step. In certain embodiments, this is more efficient than attaching a conjugated nucleoside directly to the solid support as is typically done to prepare a 3'-conjugated oligonucleotide. The Examples herein demonstrate attachment at the 5'-end. In addition, certain conjugate groups have synthetic advantages. For Example, certain conjugate groups comprising phosphorus linkage groups are synthetically simpler and more efficiently prepared than other conjugate groups, including conjugate groups reported previously (e.g., WO/2012/037254).

In certain embodiments, conjugated antisense compounds are administered to a subject. In such embodiments, antisense compounds comprising one or more conjugate group described herein has increased activity and/or potency and/or tolerability compared to a parent antisense compound lacking such one or more conjugate group. Without being bound by mechanism, it is believed that the conjugate group helps with distribution, delivery, and/or uptake into a target cell or tissue. In certain embodiments, once inside the target cell or tissue, it is desirable that all or part of the conjugate group to be cleaved to release the active oligonucleotide. In certain embodiments, it is not necessary that the entire conjugate group be cleaved from the oligonucleotide. For example, in Example 20a conjugated oligonucleotide was administered to mice and a number of different chemical species, each comprising a different portion of the conjugate group remaining on the oligonucleotide, were detected (Table 23a). This conjugated antisense compound demonstrated good potency (Table 23). Thus, in certain embodiments, such metabolite profile of multiple partial cleavage of the conjugate group does not interfere with activity/potency. Nevertheless, in certain embodiments it is desirable that a prodrug (conjugated oligonucleotide) yield a single active compound. In certain instances, if multiple forms of the active compound are found, it may be necessary to determine relative amounts and activities for each one. In certain embodiments where regulatory review is required (e.g., USFDA or counterpart) it is desirable to have a single (or predominantly single) active species. In certain such embodiments, it is desirable that such single active species be the antisense oligonucleotide lacking any portion of the conjugate group. In certain embodiments, conjugate groups at the 5'-end are more likely to result in complete metabolism of the conjugate group. Without being bound by mechanism it may be that endogenous enzymes responsible for metabolism at the 5' end (e.g., 5' nucleases) are more active/efficient than the 3' counterparts. In certain embodiments, the specific conjugate groups are more amenable to metabolism to a single active species. In certain embodiments, certain conjugate groups are more amenable to metabolism to the oligonucleotide.

D. Antisense

In certain embodiments, oligomeric compounds of the present invention are antisense compounds. In such embodiments, the oligomeric compound is complementary to a target nucleic acid. In certain embodiments, a target nucleic acid is an RNA. In certain embodiments, a target nucleic acid is a non-coding RNA. In certain embodiments, a target nucleic acid encodes a protein. In certain embodiments, a target nucleic acid is selected from a mRNA, a pre-mRNA, a microRNA, a non-coding RNA, including small non-coding RNA, and a promoter-directed RNA. In certain embodiments, oligomeric compounds are at least partially complementary to more than one target nucleic acid. For example, oligomeric compounds of the present invention may be microRNA mimics, which typically bind to multiple targets.

In certain embodiments, antisense compounds comprise a portion having a nucleobase sequence at least 70% complementary to the nucleobase sequence of a target nucleic acid.

In certain embodiments, antisense compounds comprise a portion having a nucleobase sequence at least 80% complementary to the nucleobase sequence of a target nucleic acid. In certain embodiments, antisense compounds comprise a portion having a nucleobase sequence at least 90% complementary to the nucleobase sequence of a target nucleic acid. In certain embodiments, antisense compounds comprise a portion having a nucleobase sequence at least 95% complementary to the nucleobase sequence of a target nucleic acid. In certain embodiments, antisense compounds comprise a portion having a nucleobase sequence at least 98% complementary to the nucleobase sequence of a target nucleic acid. In certain embodiments, antisense compounds comprise a portion having a nucleobase sequence that is 100% complementary to the nucleobase sequence of a target nucleic acid. In certain embodiments, antisense compounds are at least 70%, 80%, 90%, 95%, 98%, or 100% complementary to the nucleobase sequence of a target nucleic acid over the entire length of the antisense compound.

Antisense mechanisms include any mechanism involving the hybridization of an oligomeric compound with target nucleic acid, wherein the hybridization results in a biological effect. In certain embodiments, such hybridization results in either target nucleic acid degradation or occupancy with concomitant inhibition or stimulation of the cellular machinery involving, for example, translation, transcription, or polyadenylation of the target nucleic acid or of a nucleic acid with which the target nucleic acid may otherwise interact.

One type of antisense mechanism involving degradation of target RNA is RNase H mediated antisense. RNase H is a cellular endonuclease which cleaves the RNA strand of an RNA:DNA duplex. It is known in the art that single-stranded antisense compounds which are "DNA-like" elicit RNase H activity in mammalian cells. Activation of RNase H, therefore, results in cleavage of the RNA target, thereby greatly enhancing the efficiency of DNA-like oligonucleotide-mediated inhibition of gene expression.

Antisense mechanisms also include, without limitation RNAi mechanisms, which utilize the RISC pathway. Such RNAi mechanisms include, without limitation siRNA, ssRNA and microRNA mechanisms. Such mechanisms include creation of a microRNA mimic and/or an anti-microRNA.

Antisense mechanisms also include, without limitation, mechanisms that hybridize or mimic non-coding RNA other than microRNA or mRNA. Such non-coding RNA includes, but is not limited to promoter-directed RNA and short and long RNA that effects transcription or translation of one or more nucleic acids.

In certain embodiments, oligonucleotides comprising conjugates described herein are RNAi compounds. In certain embodiments, oligomeric oligonucleotides comprising conjugates described herein are ssRNA compounds. In certain embodiments, oligonucleotides comprising conjugates described herein are paired with a second oligomeric compound to form an siRNA. In certain such embodiments, the second oligomeric compound also comprises a conjugate. In certain embodiments, the second oligomeric compound is any modified or unmodified nucleic acid. In certain embodiments, the oligonucleotides comprising conjugates described herein is the antisense strand in an siRNA compound. In certain embodiments, the oligonucleotides comprising conjugates described herein is the sense strand in an siRNA compound. In embodiments in which the conjugated oligomeric compound is double-stranded siRNA, the conjugate may be on the sense strand, the antisense strand or both the sense strand and the antisense strand.

D. Target Nucleic Acids, Regions and Segments

In certain embodiments, conjugated antisense compounds target any nucleic acid. In certain embodiments, the target nucleic acid encodes a target protein that is clinically relevant. In such embodiments, modulation of the target nucleic acid results in clinical benefit. Certain target nucleic acids include, but are not limited to, the target nucleic acids illustrated in Table 1.

TABLE 1

Certain Target Nucleic Acids

| Target | Species | GENBANK ® Accession Number | SEQ ID NO |
|---|---|---|---|
| Androgen Receptor (AR) | Human | NT_011669.17 truncated from nucleobases 5079000 to 5270000 | 1 |
| Apolipoprotein (a) (Apo(a)) | Human | NM_005577.2 | 2 |
| Apolipoprotein B (ApoB) | Human | NM_000384.1 | 3 |
| Apolipoprotein C-III (ApoCIII) | Human | NT_033899.8 truncated from nucleobases 20262640 to 20266603 | 4 |
| Apolipoprotein C-III (ApoCIII) | Human | NM_000040.1 | 5 |
| C-Reactive Protein (CRP) | Human | M11725.1 | 6 |
| eIF4E | Human | M15353.1 | 7 |
| Factor VII | Human | NT_027140.6 truncated from nucleobases 1255000 to 1273000 | 8 |
| Factor XI | Human | NM_000128.3 | 9 |
| Glucocorticoid Receptor (GCCR) | Human | the complement NT_029289.10 truncated from nucleobases 3818000 to 3980000 | 10 |
| Glucagon Receptor (GCGR) | Human | NW_926918.1 truncated from nucleobases 16865000 to 16885000 | 11 |
| HBV | Human | U95551.1 | 12 |
| Protein Tyrosine Phosphatase 1B (PTP1B) | Human | NM_002827.2 | 13 |
| Protein Tyrosine Phosphatase 1B (PTP1B) | Human | NT_011362.9 truncated from nucleobases 14178000 to 14256000 | 14 |
| STAT3 | Human | NM_139276.2 | 15 |
| Transthyretin (TTR) | Human | NM_000371.3 | 16 |

The targeting process usually includes determination of at least one target region, segment, or site within the target nucleic acid for the antisense interaction to occur such that the desired effect will result.

In certain embodiments, a target region is a structurally defined region of the nucleic acid. For example, in certain such embodiments, a target region may encompass a 3' UTR, a 5' UTR, an exon, an intron, a coding region, a translation initiation region, translation termination region, or other defined nucleic acid region or target segment.

In certain embodiments, a target segment is at least about an 8-nucleobase portion of a target region to which a conjugated antisense compound is targeted. Target segments can include DNA or RNA sequences that comprise at least 8 consecutive nucleobases from the 5'-terminus of one of the target segments (the remaining nucleobases being a consecutive stretch of the same DNA or RNA beginning immediately upstream of the 5'-terminus of the target segment and continuing until the DNA or RNA comprises about 8 to about 30 nucleobases). Target segments are also represented by DNA or RNA sequences that comprise at least 8 consecutive nucleobases from the 3'-terminus of one of the target segments (the remaining nucleobases being a consecutive stretch of the same DNA or RNA beginning immediately downstream of the 3'-terminus of the target segment and continuing until the DNA or RNA comprises about 8 to about 30 nucleobases). Target segments can also be represented by DNA or RNA sequences that comprise at least 8 consecutive nucleobases from an internal portion of the sequence of a target segment, and may extend in either or both directions until the conjugated antisense compound comprises about 8 to about 30 nucleobases.

In certain embodiments, antisense compounds targeted to the nucleic acids listed in Table 1 can be modified as described herein. In certain embodiments, the antisense compounds can have a modified sugar moiety, an unmodified sugar moiety or a mixture of modified and unmodified sugar moieties as described herein. In certain embodiments, the antisense compounds can have a modified internucleoside linkage, an unmodified internucleoside linkage or a mixture of modified and unmodified internucleoside linkages as described herein. In certain embodiments, the antisense compounds can have a modified nucleobase, an unmodified nucleobase or a mixture of modified and unmodified nucleobases as described herein. In certain embodiments, the antisense compounds can have a motif as described herein.

In certain embodiments, antisense compounds targeted to the nucleic acids listed in Table 1 can be conjugated as described herein.

1. Androgen Receptor (AR)

AR is a transcription factor implicated as a driver of prostate cancer. AR is activated by binding to its hormone ligands: androgen, testosterone, and/or DHT. Androgen deprivation therapy, also known as "chemical castration," is a first-line treatment strategy against hormone-sensitive, androgen-dependent prostate cancer that reduces circulating androgen levels and thereby inhibits AR activity. However, androgen deprivation therapy frequently leads to the emergence and growth of "castration-resistant" advanced prostate cancer, in which AR signaling is reactivated independent of ligand binding. The mechanisms underlying castration resistance in advanced prostate cancer remain unclear.

Certain Conjugated Antisense Compounds Targeted to an AR Nucleic Acid

In certain embodiments, conjugated antisense compounds are targeted to an AR nucleic acid having the sequence of GENBANK® Accession No. NT_011669.17 nucleobases 5079000 to 5270000, incorporated herein as SEQ ID NO: 1. In certain such embodiments, a conjugated antisense compound is at least 90%, at least 95%, or 100% complementary to SEQ ID NO: 1.

In certain embodiments, a conjugated antisense compound targeted to SEQ ID NO: 1 comprises an at least 8 consecutive nucleobase sequence selected from the nucleobase sequence of any of SEQ ID NOs: 17-24. In certain embodiments, a conjugated antisense compound targeted to SEQ ID NO: 1 comprises a nucleobase sequence selected from the nucleobase sequence of any of SEQ ID NOs: 17-24. In certain embodiments, such conjugated antisense compounds comprise a conjugate comprising 1-3 GalNAc ligands. In certain embodiments, such antisense compounds comprise a conjugate disclosed herein.

TABLE 2

Antisense Compounds Targeted to AR SEQ ID NO: 1

| ISIS No | Target Start Site | Sequence | Motif | SEQ ID NO |
|---|---|---|---|---|
| 560131 | 58721 58751 | TTGATTTAATGGTTGC | kkkddddddddddkkke | 17 |
| 569213 | 58720 58750 | TGATTTAATGGTTGCA | kkkddddddddddkkke | 18 |
| 569216 | 58720 58750 | TGATTTAATGGTTGCA | ekkkddddddddddkkke | 18 |
| 569221 | 58720 58750 | TGATTTAATGGTTGCA | eekkkddddddddkkk | 18 |
| 569236 | 58720 58750 | TGATTTAATGGTTGCA | ekkkddddddddkkkee | 18 |
| 579671 | 58721 58751 | TTGATTTAATGGTTGC | ekkekkddddddddkkk | 17 |
| 586124 | 58719 | GATTTAATGGTTGCAA | kkkddddddddddkkk | 19 |
| 583918 | 5052 | AGTCGCGACTCTGGTA | kkkddddddddddkkk | 20 |
| 584149 | 8638 | GTCAATATCAAAGCAC | kkkddddddddddkkk | 21 |
| 584163 | 11197 | GAACATTATTAGGCTA | kkkddddddddddkkk | 22 |
| 584269 | 40615 | CCTTATGGATGCTGCT | kkkddddddddddkkk | 23 |
| 584468 | 115272 | CATTGTACTATGCCAG | kkkddddddddddkkk | 24 |

AR Therapeutic Indications

In certain embodiments, the invention provides methods for using a conjugated antisense compound targeted to an AR nucleic acid for modulating the expression of AR in a subject. In certain embodiments, the expression of AR is reduced.

In certain embodiments, the invention provides methods for using a conjugated antisense compound targeted to an AR nucleic acid in a pharmaceutical composition for treating a subject. In certain embodiments, the subject has prostate cancer, such as castration-resistant prostate cancer. In certain embodiments, the subject has prostate cancer resistant to a diarylhydantoin Androgen Receptor (AR) inhibitor, such as MDV3100, which is also known as Enzalutamide. MDV3100 or Enzalutamide is an experimental androgen receptor antagonist drug developed by Medivation for the treatment of castration-resistant prostate cancer. In certain embodiments, the subject has breast cancer. In certain aspects, the subject's breast cancer can have one or more of the following characteristics: Androgen Receptor positive, dependent on androgen for growth, Estrogen Receptor (ER) negative, independent of estrogen for growth, Progesterone Receptor (PR) negative, independent of progesterone for growth, or Her2/neu negative. In certain aspects, the breast cancer or breast cancer cell is apocrine.

In certain embodiments, the invention provides methods for using a conjugated antisense compound targeted to an AR nucleic acid in the preparation of a medicament.

2. Apolipoprotein (a) (Apo(a))

One Apo(a) protein is linked via a disulfide bond to a single ApoB protein to form a lipoprotein(a) (Lp(a)) particle. The Apo(a) protein shares a high degree of homology with plasminogen particularly within the kringle IV type 2 repetitive domain. It is thought that the kringle repeat domain in Apo(a) may be responsible for its pro-thrombotic and anti-fibrinolytic properties, potentially enhancing atherosclerotic progression. Apo(a) is transcriptionally regulated by IL-6 and in studies in rheumatoid arthritis patients treated with an IL-6 inhibitor (tocilizumab), plasma levels were reduced by 30% after 3 month treatment. Apo(a) has been shown to preferentially bind oxidized phospholipids and potentiate vascular inflammation. Further, studies suggest that the Lp(a) particle may also stimulate endothelial permeability, induce plasminogen activator inhibitor type-1 expression and activate macrophage interleukin-8 secretion. Importantly, recent genetic association studies revealed that Lp(a) was an independent risk factor for myocardial infarction, stroke, peripheral vascular disease and abdominal aortic aneurysm. Further, in the Precocious Coronary Artery Disease (PROCARDIS) study, Clarke et al. described robust and independent associations between coronary heart disease and plasma Lp(a) concentrations. Additionally, Solfrizzi et al., suggested that increased serum Lp(a) may be linked to an increased risk for Alzheimer's Disease (AD). Antisense compounds targeting Apo(a) have been previously disclosed in WO2005/000201 and U.S. 61/651,539, herein incorporated by reference in its entirety.

An antisense oligonucleotide targeting Apo(a), ISIS-APOA$_{Rx}$, is currently in a Phase I clinical trial to study its safety profile.

Certain Conjugated Antisense Compounds Targeted to an Apo(a) Nucleic Acid

In certain embodiments, conjugated antisense compounds are targeted to an Apo(a) nucleic acid having the sequence of GENBANK® Accession No. NM_005577.2, incorporated herein as SEQ ID NO: 2. In certain such embodiments, a conjugated antisense compound is at least 90%, at least 95%, or 100% complementary to SEQ ID NO: 2.

In certain embodiments, a conjugated antisense compound targeted to SEQ ID NO: 2 comprises an at least 8 consecutive nucleobase sequence selected from the nucleobase sequence of any of SEQ ID NOs: 25-30. In certain embodiments, a conjugated antisense compound targeted to SEQ ID NO: 2 comprises a nucleobase sequence selected from the nucleobase sequence of any of SEQ ID NOs: 25-30. In certain embodiments, such conjugated antisense compounds comprise a conjugate comprising 1-3 GalNAc ligands. In certain embodiments, such antisense compounds comprise a conjugate disclosed herein.

TABLE 3

Antisense Compounds targeted to Apo(a) SEQ ID NO: 2

| ISIS No | Target Start Site | Sequence (5'-3') Motif | SEQ ID NO |
|---|---|---|---|
| 494372 | 3901 | TGCTCCGTTGGTGCTTGTTCeeeeeddddddddddeeeee | 25 |
| 494283 | 584<br>926<br>1610<br>1952<br>2294<br>3320 | TCTTCCTGTGACAGTGGTGGeeeeeddddddddddeeeee | 26 |
| 494284 | 585<br>927<br>1611<br>1953<br>2295<br>3321 | TTCTTCCTGTGACAGTGGTGeeeeeddddddddddeeeee | 27 |
| 494286 | 587<br>929<br>1613<br>1955<br>2297 | GGTTCTTCCTGTGACAGTGGeeeeeddddddddddeeeee | 28 |
| 494301 | 628<br>970<br>1312<br>1654<br>1996<br>2338<br>2680<br>3022 | CGACTATGCGAGTGTGGTGTeeeeeddddddddddeeeee | 29 |
| 494302 | 629<br>971<br>1313<br>1655<br>1997<br>2339<br>2681<br>3023 | CCGACTATGCGAGTGTGGTGeeeeeddddddddddeeeee | 30 |

Apo(a) Therapeutic Indications

In certain embodiments, the invention provides methods for using a conjugated antisense compound targeted to an Apo(a) nucleic acid for modulating the expression of Apo(a) in a subject. In certain embodiments, the expression of Apo(a) is reduced.

In certain embodiments, the invention provides methods for using a conjugated antisense compound targeted to an Apo(a) nucleic acid in a pharmaceutical composition for treating a subject. In certain embodiments, the subject has a cardiovascular and/or metabolic disease, disorder or condition. In certain embodiments, the subject has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, and/or non-alcoholic fatty liver disease.

In certain embodiments, the invention provides methods for using a conjugated antisense compound targeted to an Apo(a) nucleic acid in the preparation of a medicament.

3. Apolipoprotein B (ApoB)

ApoB (also known as apolipoprotein B-100; ApoB-100, apolipoprotein B-48; ApoB-48 and Ag(x) antigen), is a large glycoprotein that serves an indispensable role in the assembly and secretion of lipids and in the transport and receptor-mediated uptake and delivery of distinct classes of lipoproteins. ApoB performs a variety of activities, from the absorption and processing of dietary lipids to the regulation of circulating lipoprotein levels (Davidson and Shelness, *Annu. Rev. Nutr.*, 2000, 20, 169-193). This latter property underlies its relevance in terms of atherosclerosis susceptibility, which is highly correlated with the ambient concentration of ApoB-containing lipoproteins (Davidson and Shelness, Annu. Rev. Nutr., 2000, 20, 169-193). ApoB-100 is the major protein component of LDL-C and contains the domain required for interaction of this lipoprotein species with the LDL receptor. Elevated levels of LDL-C are a risk factor for cardiovascular disease, including atherosclerosis. Antisense compounds targeting ApoB have been previously disclosed in WO2004/044181, herein incorporated by reference in its entirety. An antisense oligonucleotide targeting ApoB, KYNAMRO™, has been approved by the U.S. Food and Drug Administration (FDA) as an adjunct treatment to lipid-lowering medications and diet to reduce low density lipoprotein-cholesterol (LDL-C), ApoB, total cholesterol (TC), and non-high density lipoprotein-cholesterol (non HDL-C) in patients with homozygous familial hypercholesterolemia (HoFH). However, there is still a need to provide patients with additional and more potent treatment options.

Certain Conjugated Antisense Compounds Targeted to an ApoB Nucleic Acid

In certain embodiments, conjugated antisense compounds are targeted to an ApoB nucleic acid having the sequence of GENBANK® Accession No. NM_000384.1, incorporated herein as SEQ ID NO: 3. In certain such embodiments, a conjugated antisense compound is at least 90%, at least 95%, or 100% complementary to SEQ ID NO: 3.

In certain embodiments, a conjugated antisense compound targeted to SEQ ID NO: 3 comprises an at least 8 consecutive nucleobase sequence of SEQ ID NO: 31. In certain embodiments, a conjugated antisense compound targeted to SEQ ID NO: 3 comprises a nucleobase sequence of SEQ ID NO: 31. In certain embodiments, such conjugated antisense compounds comprise a conjugate comprising 1-3 GalNAc ligands. In certain embodiments, such antisense compounds comprise a conjugate disclosed herein.

TABLE 4

Antisense Compounds targeted to ApoB SEQ ID NO: 3

| ISIS No | Target Start Site | Sequence (5'-3') | Motif | SEQ ID NO |
|---|---|---|---|---|
| 301012 | 3249 | GCCTCAGTCTGCTTCGCACC | eeeeedddddddddeeeee | 31 |

ApoB Therapeutic Indications

In certain embodiments, the invention provides methods for using a conjugated antisense compound targeted to an ApoB nucleic acid for modulating the expression of ApoB in a subject. In certain embodiments, the expression of ApoB is reduced.

In certain embodiments, the invention provides methods for using a conjugated antisense compound targeted to an ApoB nucleic acid in a pharmaceutical composition for treating a subject. In certain embodiments, the subject has a cardiovascular and/or metabolic disease, disorder or condition. In certain embodiments, the subject has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, and/or non-alcoholic fatty liver disease.

In certain embodiments, the invention provides methods for using a conjugated antisense compound targeted to an ApoB nucleic acid in the preparation of a medicament.

4. Apolipoprotein C-III (ApoCIII)

ApoCIII is a constituent of HDL and of triglyceride (TG)-rich lipoproteins. Elevated ApoCIII levels are associated with elevated TG levels and diseases such as cardiovascular disease, metabolic syndrome, obesity and diabetes. Elevated TG levels are associated with pancreatitis. ApoCIII slows clearance of TG-rich lipoproteins by inhibiting lipolysis through inhibition of lipoprotein lipase (LPL) and through interfering with lipoprotein binding to cell-surface glycosaminoglycan matrix. Antisense compounds targeting ApoCIII have been previously disclosed in WO2004/093783 and WO2012/149495, each herein incorporated by reference in its entirety. Currently, an antisense oligonucleotide targeting ApoCIII, ISIS-APOCIII$_{Rx}$, is in Phase II clinical trials to assess its effectiveness in the treatment of diabetes or hypertriglyceridemia. However, there is still a need to provide patients with additional and more potent treatment options.

Certain Conjugated Antisense Compounds Targeted to an ApoCIII Nucleic Acid

In certain embodiments, conjugated antisense compounds are targeted to an ApoCIII nucleic acid having the sequence of GENBANK® Accession No. NT_033899.8 truncated from nucleobases 20262640 to 20266603, incorporated herein as SEQ ID NO: 4. In certain such embodiments, a conjugated antisense compound is at least 90%, at least 95%, or 100% complementary to SEQ ID NO: 4. In certain embodiments, such conjugated antisense compounds comprise a conjugate comprising 1-3 GalNAc ligands. In certain embodiments, such antisense compounds comprise a conjugate disclosed herein.

In certain embodiments, conjugated antisense compounds are targeted to an ApoCIII nucleic acid having the sequence of GENBANK® Accession No. NM_000040.1, incorporated herein as SEQ ID NO: 5. In certain such embodiments, a conjugated antisense compound is at least 90%, at least 95%, or 100% complementary to SEQ ID NO: 5. In certain embodiments, such conjugated antisense compounds comprise a conjugate comprising 1-3 GalNAc ligands. In certain embodiments, such antisense compounds comprise a conjugate disclosed herein.

In certain embodiments, a conjugated antisense compound targeted to SEQ ID NO: 5 comprises an at least 8 consecutive nucleobase sequence of SEQ ID NO: 32. In certain embodiments, a conjugated antisense compound targeted to SEQ ID NO: 5 comprises a nucleobase sequence of SEQ ID NO: 32. In certain embodiments, such conjugated antisense compounds comprise a conjugate comprising 1-3 GalNAc ligands. In certain embodiments, such antisense compounds comprise a conjugate disclosed herein.

TABLE 5

Antisense Compounds targeted to ApoCIII SEQ ID NO: 5

| ISIS No | Target Start Site | Sequence (5'-3') | Motif | SEQ ID NO |
|---|---|---|---|---|
| 304801 | 508 | AGCTTCTTGTCCAGCTTTATeeeeeddddddddddeeeee | | 32 |
| 647535 | 508 | AGCTTCTTGTCCAGCTTTATeeeeeddddddddddeeeeeod | | 32 |
| 616468 | 508 | AGCTTCTTGTCCAGCTTTATeeeeeddddddddddeeeee | | 32 |
| 647536 | 508 | AGCTTCTTGTCCAGCTTTATeeoeoeoeoddddddddddeoeoeeeod | | 32 |

ApoCIII Therapeutic Indications

In certain embodiments, the invention provides methods for using a conjugated antisense compound targeted to an ApoCIII nucleic acid for modulating the expression of ApoCIII in a subject. In certain embodiments, the expression of ApoCIII is reduced.

In certain embodiments, the invention provides methods for using a conjugated antisense compound targeted to an ApoCIII nucleic acid in a pharmaceutical composition for treating a subject. In certain embodiments, the subject has a cardiovascular and/or metabolic disease, disorder or condition. In certain embodiments, the subject has hypertriglyceridemia, non-familial hypertriglyceridemia, familial hypertriglyceridemia, heterozygous familial hypertriglyceridemia, homozygous familial hypertriglyceridemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hyperlipidemia, hypercholesterolemia, hyperfattyacidemia, hepatic steatosis, non-alcoholic steatohepatitis, pancreatitis and/or non-alcoholic fatty liver disease.

In certain embodiments, the invention provides methods for using a conjugated antisense compound targeted to an ApoCIII nucleic acid in the preparation of a medicament.

5. C-Reactive Protein (CRP)

CRP (also known as PTX1) is an essential human acute-phase reactant produced in the liver in response to a variety of inflammatory cytokines. The protein, first identified in 1930, is highly conserved and considered to be an early indicator of infectious or inflammatory conditions. Plasma CRP levels increase 1.000-fold in response to infection, ischemia, trauma, burns, and inflammatory conditions. In clinical trials where patients receive lipid-lowering therapy, such as statin therapy, it has been demonstrated that patients having reductions in both LDL-C and CRP have a reduced risk of future coronary events relative to patients experiencing only reductions in LDL-C. Antisense compounds targeting CRP have been previously disclosed in WO2003/010284 and WO2005/005599, each herein incorporated by reference in its entirety. An antisense oligonucleotide targeting CRP, ISIS-CRP$_{Rx}$, is currently in Phase 2 clinical trials to study its effectiveness in treating subjects with rheumatoid arthritis and paroxysmal atrial fibrillation. However, there is still a need to provide patients with additional and more potent treatment options.

Certain Conjugated Antisense Compounds Targeted to a CRP Nucleic Acid

In certain embodiments, conjugated antisense compounds are targeted to a CRP nucleic acid having the sequence of GENBANK® Accession No. M11725.1, incorporated herein as SEQ ID NO: 6. In certain such embodiments, a conjugated antisense compound is at least 90%, at least 95%, or 100% complementary to SEQ ID NO: 6.

In certain embodiments, a conjugated antisense compound targeted to SEQ ID NO: 6 comprises an at least 8 consecutive nucleobase sequence of SEQ ID NO: 33. In certain embodiments, a conjugated antisense compound targeted to SEQ ID NO: 6 comprises a nucleobase sequence of SEQ ID NO: 33. In certain embodiments, such conjugated antisense compounds comprise a conjugate comprising 1-3 GalNAc ligands. In certain embodiments, such antisense compounds comprise a conjugate disclosed herein.

TABLE 6

Antisense Compounds targeted to CRP SEQ ID NO: 6

| ISIS No | Target Start Site | Sequence (5'-3') | Motif | SEQ ID NO |
|---|---|---|---|---|
| 329993 | 1378 | AGCATAGTTAACGAGCTCCC | eeeeedddddddddeeeee | 33 |

CRP Therapeutic Indications

In certain embodiments, the invention provides methods for using a conjugated antisense compound targeted to a CRP nucleic acid for modulating the expression of CRP in a subject. In certain embodiments, the expression of CRP is reduced.

In certain embodiments, the invention provides methods for using a conjugated antisense compound targeted to a CRP nucleic acid in a pharmaceutical composition for treating a subject. In certain embodiments, the subject has a cardiovascular and/or metabolic disease, disorder or condition. In certain embodiments, the subject has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease. In certain embodiments, the individual has paroxysmal atrial fibrillation, acute coronary syndrome, vascular injury, arterial occlusion, unstable angina, post peripheral vascular disease, post myocardial infarction (MI), thrombosis, deep vein thrombus, end-stage renal disease (ESRD), chronic renal failure, complement activation, congestive heart failure, or systemic vasculitis. In certain embodiments, the individual has had a stroke. In certain embodiments, the individual has undergone a procedure selected from elective stent placement, angioplasty, post percutaneous transluminal angioplasty (PTCA), cardiac transplantation, renal dialysis or cardiopulmonary bypass. In certain embodiments, the individual has an inflammatory disease. In certain such embodiments, the inflammatory disease is selected from inflammatory bowel disease, ulcerative colitis, rheumatoid arthritis, or osteoarthritis.

In certain embodiments, the invention provides methods for using a conjugated antisense compound targeted to a CRP nucleic acid in the preparation of a medicament.

6. eIF4E

Overexpression of eIF4E has been reported in many human cancers and cancer-derived cell lines and also leads to oncogenic transformation of cells and invasive/metastatic phenotype in animal models. Unlike non-transformed, cultured cells, transformed cell lines express eIF4E independently of the presence of serum growth factors (Rosenwald, Cancer Lett., 1995, 98, 77-82). Excess eIF4E leads to aberrant growth and neoplastic morphology in HeLa cells and also causes tumorigenic transformation in NIH 3T3 and Rat2 fibroblasts, as judged by anchorage-independent growth, formation of transformed foci in culture and tumor formation in nude mice (De Benedetti et al., Proc. Natl. Acad. Sci. USA, 1990, 87, 8212-8216; and Lazaris-Karatzas et al., Nature, 1990, 345, 544-547).

eIF4E is found elevated in several human cancers, including but not limited to non-Hodgkin's lymphomas, colon adenomas and carcinomas and larynx, head and neck, prostate, breast and bladder cancers (Crew et al., Br. J. Cancer, 2000, 82, 161-166; Graff et al., Clin. Exp. Metastasis, 2003, 20, 265-273; Haydon et al., Cancer, 2000, 88, 2803-2810; Kerekatte et al., Int. J. Cancer, 1995, 64, 27-31; Rosenwald et al., Oncogene, 1999, 18, 2507-2517; Wang et al., Am. J. Pathol., 1999, 155, 247-255). Upregulation of eIF4E is an early event in colon carcinogenesis, and is frequently accompanied by an increase in cyclin D1 levels (Rosenwald et al., Oncogene, 1999, 18, 2507-2517). Antisense compounds targeting eIF4E have been previously disclosed in WO2005/028628, herein incorporated by reference in its entirety. An antisense oligonucleotide targeting eIF4E, ISIS-eIF4E, is currently in Phase 1/2 clinical trials to study its effectiveness in treating subjects with cancer.

Certain Conjugated Antisense Compounds Targeted to an eIF4E Nucleic Acid

In certain embodiments, conjugated antisense compounds are targeted to an eIF4E nucleic acid having the sequence of GENBANK® Accession No. M15353.1, incorporated herein as SEQ ID NO: 7. In certain such embodiments, a conjugated antisense compound is at least 90%, at least 95%, or 100% complementary to SEQ ID NO: 7.

In certain embodiments, a conjugated antisense compound targeted to SEQ ID NO: 7 comprises an at least 8 consecutive nucleobase sequence of SEQ ID NO: 34. In certain embodiments, a conjugated antisense compound targeted to SEQ ID NO: 7 comprises a nucleobase sequence of SEQ ID NO: 34. In certain embodiments, such conjugated antisense compounds comprise a conjugate comprising 1-3 GalNAc ligands. In certain embodiments, such antisense compounds comprise a conjugate disclosed herein.

TABLE 7

Antisense Compounds targeted to eIF4E SEQ ID NO: 7

| ISIS No | Target Start Site | Sequence (5'-3') | Motif | SEQ ID NO |
|---|---|---|---|---|
| 183750 | 1285 | TGTCATATTCCTGGATCCTT | eeeeedddddddddeeeee | 34 | eIF4E Therapeutic Indications

In certain embodiments, the invention provides methods for using a conjugated antisense compound targeted to an eIF4E nucleic acid for modulating the expression of eIF4E in a subject. In certain embodiments, the expression of eIF4E is reduced.

In certain embodiments, the invention provides methods for using a conjugated antisense compound targeted to an eIF4E nucleic acid in a pharmaceutical composition for treating a subject. In certain embodiments, the subject has cancer. In certain aspects, the cancer is prostate cancer.

In certain embodiments, the invention provides methods for using a conjugated antisense compound targeted to an eIF4E nucleic acid in the preparation of a medicament.

7. Factor VII

Coagulation Factor VII (also known as serum prothrombin conversion accelerator) is a key component of the tissue factor coagulation pathway. Clinicians have linked elevated levels of Factor VII activity with poor prognosis in several thrombotic diseases, such as heart attacks, and with cancer-associated thrombosis, which is the second leading cause of death in cancer patients. In preclinical studies, antisense inhibition of Factor VII rapidly reduced Factor VII activity by more than 90 percent in three days with no observed increase in bleeding, which is a common side effect of currently available anti-thrombotic drugs. Antisense compounds targeting Factor VII have been previously disclosed in WO2009/061851, WO2012/174154, and PCT Application no. PCT/US2013/025381, each herein incorporated by reference in its entirety. Clinical studies are planned to assess ISIS-FVII$_{Rx}$ in acute clinical settings, such as following surgery, to prevent patients from developing harmful blood clots. However, there is still a need to provide patients with additional and more potent treatment options.

Certain Conjugated Antisense Compounds Targeted to a Factor VII Nucleic Acid

In certain embodiments, conjugated antisense compounds are targeted to a Factor VII nucleic acid having the sequence of GENBANK® Accession No. NT_027140.6 truncated from nucleobases 1255000 to 1273000), incorporated herein as SEQ ID NO: 8. In certain such embodiments, a conjugated antisense compound targeted to SEQ ID NO: 8 is at least 90%, at least 95% or 100% complementary to SEQ ID NO: 8.

In certain embodiments, a conjugated antisense compound targeted to SEQ ID NO: 8 comprises an at least 8 consecutive nucleobase sequence of SEQ ID NOs: 35-43. In certain embodiments, a conjugated antisense compound targeted to SEQ ID NO: 8 comprises a nucleobase sequence of SEQ ID NOs: 35-43. In certain embodiments, such conjugated antisense compounds comprise a conjugate comprising 1-3 GalNAc ligands. In certain embodiments, such antisense compounds comprise a conjugate disclosed herein.

TABLE 8

Antisense Compounds targeted to Factor VII
SEQ ID NO: 8

| ISIS No | Target Start Site | Sequence (5'-3') | Motif | SEQ ID NO |
|---|---|---|---|---|
| 540175 | 2592 | GGACACCCACGCCCCC | eekddddddddddkke | 35 |
|  | 2626 |  |  |  |
|  | 2660 |  |  |  |
|  | 2796 |  |  |  |
|  | 2966 |  |  |  |
|  | 3000 |  |  |  |
|  | 3034 |  |  |  |
|  | 3068 |  |  |  |
|  | 3153 |  |  |  |
|  | 3170 |  |  |  |
|  | 3272 |  |  |  |
|  | 3374 |  |  |  |
|  | 3578 |  |  |  |
|  | 3851 |  |  |  |
|  | 3953 |  |  |  |
|  | 4124 |  |  |  |
|  | 4260 |  |  |  |
|  | 4311 |  |  |  |
|  | 4447 |  |  |  |
|  | 4532 |  |  |  |
| 490279 | 1387 | CCCTCCTGTGCCTGGATGCT | eeeeeddddddddddeeeee | 36 |
| 473589 | 15128 | GCTAAACAACCGCCTT | kdkdkdddddddddee | 37 |
| 407935 | 15191 | ATGCATGGTGATGCTTCTGA | eeeeeddddddddddeeeee | 38 |
| 529804 | 15192 | CATGGTGATGCTTCTG | kddddddddddkekee | 39 |
| 534796 | 15131 | AGAGCTAAACAACCGC | Ekkddddddddddkke | 40 |
| 540162 | 2565 | ACTCCCGGGACACCCA | eekddddddddddkke | 41 |
|  | 2633 |  |  |  |
|  | 2667 |  |  |  |
|  | 2735 |  |  |  |
|  | 2803 |  |  |  |
|  | 2837 |  |  |  |
|  | 2905 |  |  |  |
|  | 3007 |  |  |  |
|  | 3041 |  |  |  |

TABLE 8-continued

Antisense Compounds targeted to Factor VII
SEQ ID NO: 8

| ISIS No | Target Start Site | Sequence (5'-3') | Motif | SEQ ID NO |
|---|---|---|---|---|
| | 3075 | | | |
| | 3092 | | | |
| | 3279 | | | |
| | 3381 | | | |
| | 3483 | | | |
| | 3603 | | | |
| | 3722 | | | |
| | 3756 | | | |
| | 3858 | | | |
| | 3892 | | | |
| | 3960 | | | |
| | 4046 | | | |
| | 4131 | | | |
| | 4165 | | | |
| | 4318 | | | |
| | 4454 | | | |
| 540182 | 2692 | ACACCCTCGCCTCCGG | eekddddddddddkke | 42 |
| | 2760 | | | |
| | 2862 | | | |
| | 2930 | | | |
| | 3117 | | | |
| | 3338 | | | |
| | 3440 | | | |
| | 3508 | | | |
| | 3542 | | | |
| | 3628 | | | |
| | 3662 | | | |
| | 3781 | | | |
| | 3815 | | | |
| | 3917 | | | |
| | 4190 | | | |
| | 4224 | | | |
| | 4377 | | | |
| | 4411 | | | |
| 540191 | 3109 | GCCTCCGGAACACCCA | eekddddddddddkke | 43 |
| | 3194 | | | |
| | 3330 | | | |
| | 3432 | | | |
| | 3500 | | | |
| | 3534 | | | |
| | 3620 | | | |
| | 3654 | | | |
| | 3773 | | | |
| | 4182 | | | |
| | 4216 | | | |
| | 4369 | | | |
| | 4403 | | | |

Factor VII Therapeutic Indications

In certain embodiments, the invention provides methods for using a conjugated antisense compound targeted to a Factor VII nucleic acid for modulating the expression of Factor VII in a subject. In certain embodiments, the expression of Factor VII is reduced.

In certain embodiments, the invention provides methods for using a conjugated antisense compound targeted to a Factor VII nucleic acid in a pharmaceutical composition for treating a subject. In certain embodiments, the subject has or is at risk of developing a thromboembolic condition, such as, heart attack, stroke, deep vein thrombosis, or pulmonary embolism. In certain embodiments, the subject is at risk of developing a thromboembolic condition and/or otherwise in need of anticoagulant therapy. Examples of such subjects include those undergoing major orthopedic surgery and patients in need of chronic anticoagulant treatment. In certain embodiments, the subject has or is at risk of developing an inflammatory disease, disorder or condition. In certain embodiments, the subject has or is at risk of developing allergic diseases (e.g., allergic rhinitis, chronic rhinosinusitis), autoimmune diseases (e.g, multiple sclerosis, arthritis, scleroderma, psoriasis, celiac disease), cardiovascular diseases, colitis, diabetes (e.g., type 1 insulin-dependent diabetes mellitus), hypersensitivities (e.g., Type1, 2, 3 or 4 hypersensitivity), infectious diseases (e.g., viral infection, mycobacterial infection, helminth infection), posterior uveitis, airway hyperresponsiveness, asthma, atopic dermatitis, colitis, endometriosis, thyroid disease (e.g., Graves' disease) and pancreatitis.

In certain embodiments, the invention provides methods for using a conjugated antisense compound targeted to a Factor VII nucleic acid in the preparation of a medicament.

8. Factor XI

Coagulation factor XI (also known as plasma thromboplastin antecedent) is an important member of the coagulation pathway. High levels of Factor XI increase the risk of thrombosis, a process involving aberrant blood clot formation responsible for most heart attacks and strokes. Elevated levels of Factor XI also increase the risk of venous thrombosis, a common problem after surgery, particularly major orthopedic procedures, such as knee or hip replacement. People who are deficient in Factor XI have a lower incidence of thromboembolic events with minimal increase in bleeding risk. Antisense compounds targeting Factor XI have been previously disclosed in WO2010/045509 and WO2010/121074, each herein incorporated by reference in its entirety. Currently, an antisense oligonucleotide targeting Factor XI, ISIS-FXI$_{Rx}$, is in Phase 2 clinical studies to assess the effectiveness of ISIS-FXI$_{Rx}$ in reducing the number of thrombotic events in patients following total knee arthroplasty without increasing bleeding. However, there is still a need to provide patients with additional and more potent treatment options.

Certain Conjugated Antisense Compounds Targeted to a Factor XI Nucleic Acid

In certain embodiments, conjugated antisense compounds are targeted to a Factor XI nucleic acid having the sequence of GENBANK® Accession No. NM_000128.3, incorporated herein as SEQ ID NO: 9. In certain such embodiments, a conjugated antisense compound is at least 90%, at least 95%, or 100% complementary to SEQ ID NO: 9.

In certain embodiments, a conjugated antisense compound targeted to SEQ ID NO: 9 comprises an at least 8 consecutive nucleobase sequence of SEQ ID NOs: 44-48. In certain embodiments, a conjugated antisense compound targeted to SEQ ID NO: 9 comprises a nucleobase sequence of SEQ ID NOs: 44-48. In certain embodiments, such conjugated antisense compounds comprise a conjugate comprising 1-3 GalNAc ligands. In certain embodiments, such antisense compounds comprise a conjugate disclosed herein.

patients in need of chronic anticoagulant treatment. In certain embodiments, the subject has or is at risk of developing an inflammatory disease, disorder or condition. In certain embodiments, the subject has or is at risk of developing allergic diseases (e.g., allergic rhinitis, chronic rhinosinusitis), autoimmune diseases (e.g, multiple sclerosis, arthritis, scleroderma, psoriasis, celiac disease), cardiovascular diseases, colitis, diabetes (e.g., type 1 insulin-dependent diabetes mellitus), hypersensitivities (e.g., Type1, 2, 3 or 4 hypersensitivity), infectious diseases (e.g., viral infection, mycobacterial infection, helminth infection), posterior uveitis, airway hyperresponsiveness, asthma, atopic dermatitis, colitis, endometriosis, thyroid disease (e.g., Graves' disease) and pancreatitis.

In certain embodiments, the invention provides methods for using a conjugated antisense compound targeted to a Factor XI nucleic acid in the preparation of a medicament.

9. Glucocorticoid Receptor (GCCR)

Complementary DNA clones encoding the human glucocorticoid receptor (also known as nuclear receptor subfamily 3, group C, member 1; NR3C1; GCCR; GCR; GRL; Glucocorticoid receptor, lymphocyte) were first isolated in 1985 (Hollenberg et al., *Nature*, 1985, 318, 635-641; Weinberger et al., *Science*, 1985, 228, 740-742). The gene is located on human chromosome 5q11-q13 and consists of 9 exons (Encio and Detera-Wadleigh, *J Biol Chem*, 1991, 266, 7182-7188; Gehring et al., *Proc Natl Acad Sci USA*, 1985, 82, 3751-3755).

The human glucocorticoid receptor is comprised of three major domains, the N-terminal activation domain, the central DNA-binding domain and the C-terminal ligand-binding domain (Giguere et al., *Cell*, 1986, 46, 645-652). In the absence of ligand, the glucocorticoid receptor forms a large

TABLE 9

Antisense Compounds targeted to Factor XI SEQ ID NO: 9

| ISIS No | Target Start Site | Sequence (5'-3') Motif | SEQ ID NO |
|---|---|---|---|
| 416858 | 1288 | ACGGCATTGGTGCACAGTTTeeeeeddddddddddeeeee | 44 |
| 416838 | 1022 | GCAACCGGGATGATGAGTGCeeeeeddddddddddeeeee | 45 |
| 416850 | 1278 | TGCACAGTTTCTGGCAGGCCeeeeeddddddddddeeeee | 46 |
| 416864 | 1296 | GGCAGCGGACGGCATTGGTGeeeeeddddddddddeeeee | 47 |
| 417002 | 1280 | GGTGCACAGTTTCTGGCAGGeedddddddddddeeeee | 48 |

Factor XI Therapeutic Indications

In certain embodiments, the invention provides methods for using a conjugated antisense compound targeted to a Factor XI nucleic acid for modulating the expression of Factor XI in a subject. In certain embodiments, the expression of Factor XI is reduced.

In certain embodiments, the invention provides methods for using a conjugated antisense compound targeted to a Factor XI nucleic acid in a pharmaceutical composition for treating a subject. In certain embodiments, the subject has or is at risk of developing a thromboembolic condition, such as, heart attack, stroke, deep vein thrombosis, or pulmonary embolism. In certain embodiments, the subject is at risk of developing a thromboembolic condition and/or otherwise in need of anticoagulant therapy. Examples of such subjects include those undergoing major orthopedic surgery and heteromeric complex with several other proteins, from which it dissociates upon ligand binding.

In the liver, glucocorticoid agonists increase hepatic glucose production by activating the glucocorticoid receptor, which subsequently leads to increased expression of the gluconeogenic enzymes phosphoenolpyruvate carboxykinase (PEPCK) and glucose-6-phosphatase. Through gluconeogenesis, glucose is formed through non-hexose precursors, such as lactate, pyruvate and alanine (Link, Curr Opin Investig Drugs, 2003, 4, 421-429).

Antisense compounds targeting GCCR have been previously disclosed in WO2007/035759, WO2005/071080, and PCT application no. PCT/US2012/061984, each herein incorporated by reference in its entirety. An antisense oligonucleotide targeting GCCR, ISIS-GCCR$_{Rx}$, recently completed a Phase I clinical study with positive results. However, there is still a need to provide patients with additional and more potent treatment options.

Certain Conjugated Antisense Compounds Targeted to a GCCR Nucleic Acid

In certain embodiments, conjugated antisense compounds are targeted to a GCCR nucleic acid having the sequence of the complement of GENBANK Accession No. NT_029289.10 truncated from nucleobases 3818000 to 3980000, incorporated herein as SEQ ID NO: 10. In certain such embodiments, a conjugated antisense compound targeted to SEQ ID NO: 10 is at least 90%, at least 95%, or 100% complementary to SEQ ID NO: 10.

In certain embodiments, a conjugated antisense compound targeted to SEQ ID NO: 10 comprises an at least 8 consecutive nucleobase sequence of SEQ ID NOs: 49-59. In certain embodiments, a conjugated antisense compound targeted to SEQ ID NO: 10 comprises a nucleobase sequence of SEQ ID NOs: 49-59. In certain embodiments, such conjugated antisense compounds comprise a conjugate comprising 1-3 GalNAc ligands. In certain embodiments, such antisense compounds comprise a conjugate disclosed herein.

tom is a physical symptom selected from the group consisting of increased glucose levels, increased weight gain, frequent urination, unusual thirst, extreme hunger, extreme fatigue, blurred vision, frequent infections, tingling or numbness at the extremities, dry and itchy skin, weight loss, slow-healing sores, and swollen gums. In certain embodiments, the symptom is a physiological symptom selected from the group consisting of increased insulin resistance, increased glucose levels, increased fat mass, decreased metabolic rate, decreased glucose clearance, decreased glucose tolerance, decreased insulin sensitivity, decreased hepatic insulin sensitivity, increased adipose tissue size and weight, increased body fat, and increased body weight.

In certain embodiments, the invention provides methods for using a conjugated antisense compound targeted to a GCCR nucleic acid in the preparation of a medicament.

10. Glucagon Receptor (GCGR)

Diabetes is a chronic metabolic disorder characterized by impaired insulin secretion and/or action. In type 2 diabetes (T2DM), insulin resistance leads to an inability of insulin to control the activity of gluconeogenic enzymes, and many

TABLE 10

Antisense Compounds targeted to GCCR SEQ ID NO: 10

| ISIS No | Target Start Site | Sequence (5'-3') Motif | SEQ ID NO |
|---|---|---|---|
| 426115 | 65940 | GCAGCCATGGTGATCAGGAGeeeeedddddddddddeeeee | 49 |
| 420470 | 57825 | GGTAGAAATATAGTTGTTCCeeeeedddddddddddeeeee | 50 |
| 420476 | 59956 | TTCATGTGTCTGCATCATGTeeeeedddddddddddeeeee | 51 |
| 426130 | 63677 | GCATCCAGCGAGCACCAAAGeeeeedddddddddddeeeee | 52 |
| 426183 | 65938 | AGCCATGGTGATCAGGAGGCeeedddddddddddddeeee | 53 |
| 426261 | 65938 | AGCCATGGTGATCAGGAGGCeedddddddddddddeeeee | 53 |
| 426262 | 65939 | CAGCCATGGTGATCAGGAGGeedddddddddddddeeeee | 54 |
| 426168 | 76224 | GTCTGGATTACAGCATAAACeeeeedddddddddddeeeee | 55 |
| 426246 | 76225 | GGTCTGGATTACAGCATAAAeeedddddddddddddddeee | 56 |
| 426172 | 76229 | CCTTGGTCTGGATTACAGCAeeeeedddddddddddeeeee | 57 |
| 426325 | 76229 | CCTTGGTCTGGATTACAGCAeedddddddddddddeeeee | 58 |
| 426267 | 95513 | GTGCTTGTCCAGGATGATGCeedddddddddddddeeeee | 59 |

GCCR Therapeutic Indications

In certain embodiments, the invention provides methods for using a conjugated antisense compound targeted to a GCCR nucleic acid for modulating the expression of GCCR in a subject. In certain embodiments, the expression of GCCR is reduced.

In certain embodiments, the invention provides methods for using a conjugated antisense compound targeted to a GCCR nucleic acid in a pharmaceutical composition for treating a subject. In certain embodiments, the subject has metabolic related diseases, including metabolic syndrome, diabetes mellitus, insulin resistance, diabetic dyslipidemia, hypertriglyceridemia, obesity and weight gain.

Diabetes mellitus is characterized by numerous physical and physiological symptoms. Any symptom known to one of skill in the art to be associated with Type 2 diabetes can be ameliorated or otherwise modulated as set forth above in the methods described above. In certain embodiments, the sympsubjects also exhibit inappropriate levels of circulating glucagon in the fasting and postprandial state. Glucagon is secreted from the α-cells of the pancreatic islets and regulates glucose homeostasis through modulation of hepatic glucose production (Quesada et al., J. Endocrinol. 2008. 199: 5-19). Glucagon exerts its action on target tissues via the activation of its receptor, GCGR. The glucagon receptor is a 62 kDa protein that is a member of the class B G-protein coupled family of receptors (Brubaker et al., Recept. Channels. 2002. 8: 179-88). GCGR activation leads to signal transduction by G proteins ($G_s\alpha$ and $G_q$), whereby $G_s\alpha$ activates adenylate cyclase, which causes cAMP production, resulting in an increase in levels of protein kinase A. GCGR signaling in the liver results in increased hepatic glucose production by induction of glycogenolysis and gluconeogenesis along with inhibition of glycogenesis (Jiang and Zhang. Am. J. Physiol. Endocrinol. Metab. 2003. 284: E671-E678). GCGR is also expressed in extrahepatic tissues, which includes heart, intestinal smooth muscle, kidney, brain, and adipose tissue (Hansen et al., Peptides. 1995. 16: 1163-1166).

Antisense compounds targeting GCGR have been previously disclosed in WO2004/096996, WO2004/096016, WO2007/035771, and WO2013/043817, each herein incorporated by reference in its entirety. An antisense oligonucleotide targeting GCGR, ISIS-GCGR$_{Rx}$, recently completed a Phase I clinical study with positive results. However, there is still a need to provide patients with additional and more potent treatment options.

Certain Conjugated Antisense Compounds Targeted to a GCGR Nucleic Acid

In certain embodiments, conjugated antisense compounds are targeted to a GCGR nucleic acid having the sequence of GENBANK® Accession No NW_926918.1 truncated from nucleobases 16865000 to 16885000, incorporated herein as SEQ ID NO: 11. In certain such embodiments, a conjugated antisense compound targeted to SEQ ID NO: 11 is at least 90%, at least 95%, or 100% complementary to SEQ ID NO: 11.

In certain embodiments, a conjugated antisense compound targeted to SEQ ID NO: 11 comprises an at least 8 consecutive nucleobase sequence of SEQ ID NOs: 60-67. In certain embodiments, a conjugated antisense compound targeted to SEQ ID NO: 11 comprises a nucleobase sequence of SEQ ID NOs: 60-67. In certain embodiments, such conjugated antisense compounds comprise a conjugate comprising 1-3 GalNAc ligands. In certain embodiments, such antisense compounds comprise a conjugate disclosed herein.

In certain embodiments, the invention provides methods for using a conjugated antisense compound targeted to a GCGR nucleic acid in a pharmaceutical composition for treating a subject. In certain embodiments, the subject has metabolic related diseases, including metabolic syndrome, diabetes mellitus, insulin resistance, diabetic dyslipidemia, hypertriglyceridemia, obesity and weight gain.

Diabetes mellitus is characterized by numerous physical and physiological signs and/or symptoms.

Any symptom known to one of skill in the art to be associated with Type 2 diabetes can be ameliorated or otherwise modulated as set forth above in the methods described above. In certain embodiments, the symptom or sign is a physical symptom or sign such as increased glucose levels, increased weight gain, frequent urination, unusual thirst, extreme hunger, extreme fatigue, blurred vision, frequent infections, tingling or numbness at the extremities, dry and itchy skin, weight loss, slow-healing sores, and swollen gums. In certain embodiments, the symptom or sign is a physiological symptom or sign selected from the group consisting of increased insulin resistance, increased glucose levels, increased fat mass, decreased metabolic rate, decreased glucose clearance, decreased glucose tolerance, decreased insulin sensitivity, decreased hepatic insulin sensitivity, increased adipose tissue size and weight, increased body fat, and increased body weight.

In certain embodiments, the invention provides methods for using a conjugated antisense compound targeted to a GCGR nucleic acid in the preparation of a medicament.

TABLE 11

Antisense Compounds targeted to GCGR SEQ ID NO: 11

| ISIS No | Target Start Site | Sequence (5'-3') | Motif | SEQ ID NO |
|---|---|---|---|---|
| 449884 | 7270<br>7295<br>7319<br>7344<br>7368<br>7392<br>7416<br>7440 | GGTTCCCGAGGTGCCCA | eeedddddddddeeee | 60 |
| 398471 | 8133 | TCCACAGGCCACAGGTGGGC | eeeeedddddddddeeeeee | 61 |
| 436140 | 15743 | CTCTTTATTGTTGGAGGACA | eeeeedddddddddeeeeee | 62 |
| 448766 | 9804 | GCAAGGCTCGGTTGGGCTTC | eeeeedddddddddeeeeee | 63 |
| 459014 | 10718 | GGGCAATGCAGTCCTGG | eeedddddddddeeee | 64 |
| 459032 | 7783 | GAAGGTGACACCAGCCT | eeedddddddddeeee | 65 |
| 459040 | 8144 | GCTCAGCATCCACAGGC | eeedddddddddeeee | 66 |
| 459157 | 7267<br>7292<br>7316<br>7341<br>7365<br>7389<br>7437 | GGGTTCCCGAGGTGCCCAATG | eeeeedddddddddeeeeeee | 67 |

GCGR Therapeutic Indications

In certain embodiments, the invention provides methods for using a conjugated antisense compound targeted to a GCGR nucleic acid for modulating the expression of GCGR in a subject. In certain embodiments, the expression of GCGR is reduced.

11. Hepatitis B (HBV)

Hepatitis B is a viral disease transmitted parenterally by contaminated material such as blood and blood products, contaminated needles, sexually and vertically from infected or carrier mothers to their offspring. It is estimated by the World Health Organization that more than 2 billion people have been infected worldwide, with about 4 million acute cases per year, 1 million deaths per year, and 350-400 million chronic carriers (World Health Organization: Geographic Prevalence of Hepatitis B Prevalence, 2004. http://www-.who.int/vaccines-surveillance/graphics/htmls/hepbprev.htm).

The virus, HBV, is a double-stranded hepatotropic virus which infects only humans and non-human primates. Viral replication takes place predominantly in the liver and, to a lesser extent, in the kidneys, pancreas, bone marrow and spleen (Hepatitis B virus biology. Microbiol. Mol Biol Rev. 64: 2000; 51-68). Viral and immune markers are detectable in blood and characteristic antigen-antibody patterns evolve over time. The first detectable viral marker is HBsAg, followed by hepatitis B e antigen (HBeAg) and HBV DNA. Titers may be high during the incubation period, but HBV DNA and HBeAg levels begin to fall at the onset of illness and may be undetectable at the time of peak clinical illness (Hepatitis B virus infection—natural history and clinical consequences. N Engl J. Med. 350: 2004; 1118-1129). HBeAg is a viral marker detectable in blood and correlates with active viral replication, and therefore high viral load and infectivity (Hepatitis B e antigen—the dangerous end game of hepatitis B. N Engl J. Med. 347: 2002; 208-210). The presence of anti-HBsAb and anti-HBcAb (IgG) indicates recovery and immunity in a previously infected individual.

Currently the recommended therapies for chronic HBV infection by the American Association for the Study of Liver Diseases (AASLD) and the European Association for the Study of the Liver (EASL) include interferon alpha (INFα), pegylated interferon alpha-2a (Peg-IFN2a), entecavir, and tenofovir. The nucleoside and nucleobase therapies, entecavir and tenofovir, are successful at reducing viral load, but the rates of HBeAg seroconversion and HBsAg loss are even lower than those obtained using IFNα therapy. Other similar therapies, including lamivudine (3TC), telbivudine (LdT), and adefovir are also used, but for nucleoside/nucleobase therapies in general, the emergence of resistance limits therapeutic efficacy.

Thus, there is a need in the art to discover and develop new anti-viral therapies. Additionally, there is a need for new anti-HBV therapies capable of increasing HBeAg and HBsAg seroconversion rates. Recent clinical research has found a correlation between seroconversion and reductions in HBeAg (Fried et al (2008) Hepatology 47:428) and reductions in HBsAg (Moucari et al (2009) Hepatology 49:1151). Reductions in antigen levels may have allowed immunological control of HBV infection because high levels of antigens are thought to induce immunological tolerance. Current nucleoside therapies for HBV are capable of dramatic reductions in serum levels of HBV but have little impact on HBeAg and HBsAg levels.

Antisense compounds targeting HBV have been previously disclosed in WO2011/047312, WO2012/145674, and WO2012/145697, each herein incorporated by reference in its entirety. Clinical studies are planned to assess the effect of antisense compounds targeting HBV in patients. However, there is still a need to provide patients with additional and more potent treatment options.

Certain Conjugated Antisense Compounds Targeted to a HBV Nucleic Acid

In certain embodiments, conjugated antisense compounds are targeted to a HBV nucleic acid having the sequence of GENBANK® Accession No. U95551.1, incorporated herein as SEQ ID NO: 12. In certain such embodiments, a conjugated antisense compound targeted to SEQ ID NO: 12 is at least 90%, at least 95%, or 100% complementary to SEQ ID NO: 12.

In certain embodiments, a conjugated antisense compound targeted to SEQ ID NO: 12 comprises an at least 8 consecutive nucleobase sequence of SEQ ID NO: 68. In certain embodiments, a conjugated antisense compound targeted to SEQ ID NO: 12 comprises a nucleobase sequence of SEQ ID NO: 68. In certain embodiments, such conjugated antisense compounds comprise a conjugate comprising 1-3 GalNAc ligands. In certain embodiments, such antisense compounds comprise a conjugate disclosed herein.

TABLE 12

Antisense Compounds targeted to HBV SEQ ID NO: 12

| ISIS No | Target Start Site | Sequence (5'-3') | Motif | SEQ ID NO |
|---|---|---|---|---|
| 505358 | 1583 | GCAGAGGTGAAGCGAAGTGC | eeeeedddddddddddeeeee | 68 |

HBV Therapeutic Indications

In certain embodiments, the invention provides methods for using a conjugated antisense compound targeted to a HBV nucleic acid for modulating the expression of HBV in a subject. In certain embodiments, the expression of HBV is reduced.

In certain embodiments, the invention provides methods for using a conjugated antisense compound targeted to a HBV nucleic acid in a pharmaceutical composition for treating a subject. In certain embodiments, the subject has a HBV-related condition. In certain embodiments, the HBV-related condition includes, but is not limited to, chronic HBV infection, inflammation, fibrosis, cirrhosis, liver cancer, serum hepatitis, jaundice, liver cancer, liver inflammation, liver fibrosis, liver cirrhosis, liver failure, diffuse hepatocellular inflammatory disease, hemophagocytic syndrome, serum hepatitis, and HBV viremia. In certain embodiments, the HBV-related condition may have which may include any or all of the following: flu-like illness, weakness, aches, headache, fever, loss of appetite, diarrhea, jaundice, nausea and vomiting, pain over the liver area of the body, clay- or grey-colored stool, itching all over, and dark-colored urine, when coupled with a positive test for presence of a hepatitis B virus, a hepatitis B viral antigen, or a positive test for the presence of an antibody specific for a hepatitis B viral antigen. In certain embodiments, the subject is at risk for an HBV-related condition. This includes subjects having one or more risk factors for developing an HBV-related condition, including sexual exposure to an individual infected with Hepatitis B virus, living in the same house as an individual with a lifelong hepatitis B virus infection, exposure to human blood infected with the hepatitis B virus, injection of illicit drugs, being a person who has hemophilia, and visiting an area where hepatitis B is common. In certain embodiments, the subject has been identified as in need of treatment for an HBV-related condition.

In certain embodiments, the invention provides methods for using a conjugated antisense compound targeted to a HBV nucleic acid in the preparation of a medicament.

12. Protein Tyrosine Phosphatase 1B (PTP1B)

PTP1B is a member of a family of PTPs (Barford, et al., Science 1994. 263: 1397-1404) and is a cytosolic enzyme (Neel and Tonks, Curr. Opin. Cell Biol. 1997. 9: 193-204). PTP1B is expressed ubiquitously including tissues that are key regulators of insulin metabolism such as liver, muscle and fat (Goldstein, Receptor 1993. 3: 1-15), where it is the main PTP enzyme.

PTP1B is considered to be a negative regulator of insulin signaling. PTP1B interacts with and dephosphorylates the insulin receptor, thus attenuating and potentially terminating GENBANK® Accession No. NM_002827.2, incorporated herein as SEQ ID NO: 13 or GENBANK Accession NT_011362.9 truncated from nucleobases 14178000 to 14256000, incorporated herein as SEQ ID NO: 14. In certain such embodiments, a conjugated antisense compound targeted to SEQ ID NO: 13 is at least 90%, at least 95%, or 100% complementary to SEQ ID NO: 13.

In certain embodiments, a conjugated antisense compound targeted to SEQ ID NO: 13 comprises an at least 8 consecutive nucleobase sequence of SEQ ID NOs: 69-72. In certain embodiments, a conjugated antisense compound targeted to SEQ ID NO: 13 comprises a nucleobase sequence of SEQ ID NOs: 69-72. In certain embodiments, such conjugated antisense compounds comprise a conjugate comprising 1-3 GalNAc ligands. In certain embodiments, such antisense compounds comprise a conjugate disclosed herein.

TABLE 13

Conjugated Antisense Compounds targeted to PTP1B SEQ ID NO: 13

| ISIS No | Target Start Site on mRNA | Sequence (5'-3') | Chemistry | SEQ ID NO |
|---|---|---|---|---|
| 404173 | 3290 | AATGGTTTATTCCATGGCCAeeeeeddddddddddeeeee | | 69 |
| 409826 | 3287 | GGTTTATTCCATGGCCATTGeeeeeddddddddddeeeee | | 70 |
| 142082 | 3291 | AAATGGTTTATTCCATGGCCeeeeeddddddddddeeeee | | 71 |
| 446431 | 3292 | AATGGTTTATTCCATGGC eeeedddddddddeeee | | 72 | the insulin signalling transduction (Goldstein et al., J. Biol. Chem. 2000. 275: 4383-4389). The physiological role of PTP1B in insulin signalling has been demonstrated in knockout mice models. Mice lacking the PTP1B gene were protected against insulin resistance and obesity (Elchebly et al., Science 1999. 283: 1544-1548). PTP1B-deficient mice had low adiposity, increased basal metabolic rate as well as total energy expenditure and were protected from diet-induced obesity. Insulin-stimulated glucose uptake was elevated in skeletal muscle, whereas adipose tissue was unaffected providing evidence that increased insulin sensitivity in PTP1B-deficient mice was tissue-specific (Klaman et al., Mol. Cell. Biol. 2000. 20: 5479-5489). These mice were phenotypically normal and were also resistant to diet-induced obesity, insulin resistance and had significantly lower triglyceride levels on a high-fat diet. Therefore, inhibition of PTP1B in patients suffering from Type II diabetes, metabolic syndrome, diabetic dyslipidemia, or related metabolic diseases would be beneficial.

Antisense compounds targeting PTP1B have been previously disclosed in WO2001/053528, WO2002/092772, WO2004/071407, WO2006/044531, WO2012/142458, WO2006/044531, and WO2012/142458, each herein incorporated by reference in its entirety. An antisense oligonucleotide targeting PTP1B, ISIS-PTP1B$_{Rx}$, recently completed a Phase I clinical study with positive results. However, there is still a need to provide patients with additional and more potent treatment options.

Certain Conjugated Antisense Compounds Targeted to a PTP1B Nucleic Acid

In certain embodiments, conjugated antisense compounds are targeted to a PTP1B nucleic acid having the sequence of PTP1B Therapeutic Indications In certain embodiments, the invention provides methods for using a conjugated antisense compound targeted to a PTP1B nucleic acid for modulating the expression of PTP1B in a subject. In certain embodiments, the expression of PTP1B is reduced.

In certain embodiments, the invention provides methods for using a conjugated antisense compound targeted to a PTP1B nucleic acid in a pharmaceutical composition for treating a subject. In certain embodiments, the subject has metabolic related diseases, including metabolic syndrome, diabetes mellitus, insulin resistance, diabetic dyslipidemia, hypertriglyceridemia, obesity and weight gain.

Diabetes mellitus is characterized by numerous physical and physiological symptoms. Any symptom known to one of skill in the art to be associated with Type 2 diabetes can be ameliorated or otherwise modulated as set forth above in the methods described above. In certain embodiments, the symptom is a physical symptom selected from the group consisting of increased glucose levels, increased weight gain, frequent urination, unusual thirst, extreme hunger, extreme fatigue, blurred vision, frequent infections, tingling or numbness at the extremities, dry and itchy skin, weight loss, slow-healing sores, and swollen gums. In certain embodiments, the symptom is a physiological symptom selected from the group consisting of increased insulin resistance, increased fat mass, decreased metabolic rate, decreased glucose clearance, decreased glucose tolerance, decreased insulin sensitivity, decreased hepatic insulin sensitivity, increased adipose tissue size and weight, increased body fat, and increased body weight.

In certain embodiments, the invention provides methods for using a conjugated antisense compound targeted to a PTP1B nucleic acid in the preparation of a medicament.

13. STAT3

The STAT (signal transducers and activators of transcription) family of proteins comprises DNA-binding proteins that play a dual role in signal transduction and activation of transcription. Presently, there are six distinct members of the STAT family (STAT1, STAT2, STAT3, STAT4, STAT5, and STATE) and several isoforms (STAT1α, STAT1β, STAT3 α and STAT3β). The activities of the STATs are modulated by various cytokines and mitogenic stimuli. Binding of a cytokine to its receptor results in the activation of Janus protein tyrosine kinases (JAKs) associated with these receptors. This phosphorylates STAT, resulting in translocation to the nucleus and transcriptional activation of STAT responsive genes. Phosphorylation on a specific tyrosine residue on the STATs results in their activation, resulting in the formation of homodimers and/or heterodimers of STAT which bind to specific gene promoter sequences. Events mediated by cytokines through STAT activation include cell proliferation and differentiation and prevention of apoptosis.

The specificity of STAT activation is due to specific cytokines, i.e., each STAT is responsive to a small number of specific cytokines. Other non-cytokine signaling molecules, such as growth factors, have also been found to activate STATs. Binding of these factors to a cell surface receptor associated with protein tyrosine kinase also results in phosphorylation of STAT.

STAT3 (also acute phase response factor (APRF)), in particular, has been found to be responsive to interleukin-6 (IL-6) as well as epidermal growth factor (EGF) (Darnell, Jr., J. E., et al., Science, 1994, 264, 1415-1421). In addition, STAT3 has been found to have an important role in signal transduction by interferons (Yang, C.-H., et al., Proc. Natl. Acad. Sci. USA, 1998, 95, 5568-5572). Evidence exists suggesting that STAT3 may be regulated by the MAPK pathway. ERK2 induces serine phosphorylation and also associates with STAT3 (Jain, N., et al., Oncogene, 1998, 17, 3157-3167).

STAT3 is expressed in most cell types (Zhong, Z., et al., Proc. Natl. Acad. Sci. USA, 1994, 91, 4806-4810). It induces the expression of genes involved in response to tissue injury and inflammation. STAT3 has also been shown to prevent apoptosis through the expression of bcl-2 (Fukada, T., et al., Immunity, 1996, 5, 449-460).

Recently, STAT3 was detected in the mitochondria of transformed cells, and was shown to facilitate glycolytic and oxidative phosphorylation activities similar to that of cancer cells (Gough, D. J., et al., Science, 2009, 324, 1713-1716). The inhibition of STAT3 in the mitochondria impaired malignant transformation by activated Ras. The data confirms a Ras-mediated transformation function for STAT3 in the mitochondria in addition to its nuclear roles.

Aberrant expression of or constitutive expression of STAT3 is associated with a number of disease processes.

Antisense compounds targeting STAT3 have been previously disclosed in WO2012/135736 and WO2005/083124, each herein incorporated by reference in its entirety. An antisense oligonucleotide targeting STAT3, ISIS-STAT3$_{Rx}$, is currently in Phase 1/2 clinical trials to study its effectiveness in treating subjects with cancer. However, there is still a need to provide patients with additional and more potent treatment options.

Certain Conjugated Antisense Compounds Targeted to a STAT3 Nucleic Acid

In certain embodiments, conjugated antisense compounds are targeted to a STAT3 nucleic acid having the sequence of GENBANK® Accession No. NM_139276.2, incorporated herein as SEQ ID NO: 15. In certain such embodiments, a conjugated antisense compound targeted to SEQ ID NO: 15 is at least 90%, at least 95%, or 100% complementary to SEQ ID NO: 15.

In certain embodiments, a conjugated antisense compound targeted to SEQ ID NO: 15 comprises an at least 8 consecutive nucleobase sequence of SEQ ID NO: 73. In certain embodiments, a conjugated antisense compound targeted to SEQ ID NO: 15 comprises a nucleobase sequence of SEQ ID NO: 73. In certain embodiments, such conjugated antisense compounds comprise a conjugate comprising 1-3 GalNAc ligands. In certain embodiments, such antisense compounds comprise a conjugate disclosed herein.

TABLE 14

Antisense Compounds targeted to STAT3 SEQ ID NO: 15

| ISIS No | Target Start Site | Sequence (5'-3') | Motif | SEQ ID NO |
|---|---|---|---|---|
| 481464 | 3016 | CTATTTGG ATGTCAGC | kkkddddd dddddkkk | 73 |

STAT3 Therapeutic Indications

In certain embodiments, the invention provides methods for using a conjugated antisense compound targeted to a STAT3 nucleic acid for modulating the expression of STAT3 in a subject. In certain embodiments, the expression of STAT3 is reduced.

In certain embodiments, the invention provides methods for using a conjugated antisense compound targeted to a STAT3 nucleic acid in a pharmaceutical composition for treating a subject. In certain embodiments, the subject has a hyperproliferative disease, disorder or condition. In certain embodiments such hyperproliferative disease, disorder, and condition include cancer as well as associated malignancies and metastases. In certain embodiments, such cancers include lung cancer, including non small cell lung cancer (NSCLC), pancreatic cancer, colorectal cancer, multiple myeloma, hepatocellular carcinoma (HCC), glioblastoma, ovarian cancer, osteosarcoma, head and neck cancer, breast cancer, epidermoid carcinomas, intestinal adenomas, prostate cancer, and gastric cancer.

In certain embodiments, the invention provides methods for using a conjugated antisense compound targeted to a STAT3 nucleic acid in the preparation of a medicament.

14. Transthyretin (TTR)

TTR (also known as prealbumin, hyperthytoxinemia, dysprealbuminemic, thyroxine; senile systemic amyloidosis, amyloid polyneuropathy, amyloidosis I, PALB; dystransthyretinemic, HST2651; TBPA; dysprealbuminemic euthyroidal hyperthyroxinemia) is a serum/plasma and cerebrospinal fluid protein responsible for the transport of thyroxine and retinol (Sakaki et al, Mol Biol Med. 1989, 6:161-8). Structurally, TTR is a homotetramer; point mutations and misfolding of the protein leads to deposition of amyloid fibrils and is associated with disorders, such as senile systemic amyloidosis (SSA), familial amyloid polyneuropathy (FAP), and familial amyloid cardiopathy (FAC).

TTR is synthesized primarily by the liver and the choroid plexus of the brain and, to a lesser degree, by the retina in humans (Palha, *Clin Chem Lab Med*, 2002, 40, 1292-1300). Transthyretin that is synthesized in the liver is secreted into the blood, whereas transthyretin originating in the choroid plexus is destined for the CSF. In the choroid plexus, transthyretin synthesis represents about 20% of total local protein synthesis and as much as 25% of the total CSF protein (Dickson et al., *J Biol Chem,* 1986, 261, 3475-3478).

With the availability of genetic and immunohistochemical diagnostic tests, patients with TTR amyloidosis have been found in many nations worldwide. Recent studies indicate that TTR amyloidosis is not a rare endemic disease as previously thought, and may affect as much as 25% of the elderly population (Tanskanen et al, Ann Med. 2008; 40(3):232-9).

At the biochemical level, TTR was identified as the major protein component in the amyloid deposits of FAP patients (Costa et al, *Proc. Natl. Acad. Sci. USA* 1978, 75:4499-4503) and later, a substitution of methionine for valine at position 30 of the protein was found to be the most common molecular defect causing the disease (Saraiva et al, *J. Clin. Invest.* 1984, 74: 104-119). In FAP, widespread systemic extracellular deposition of TTR aggregates and amyloid fibrils occurs throughout the connective tissue, particularly in the peripheral nervous system (Sousa and Saraiva, *Prog. Neurobiol.* 2003, 71: 385-400). Following TTR deposition, axonal degeneration occurs, starting in the unmyelinated and myelinated fibers of low diameter, and ultimately leading to neuronal loss at ganglionic sites.

Antisense compounds targeting TTR have been previously disclosed in US2005/0244869, WO2010/017509, and WO2011/139917, each herein incorporated by reference in its entirety. An antisense oligonucleotide targeting TTR, ISIS-TTR$_{Rx}$ is currently in Phase 2/3 clinical trials to study its effectiveness in treating subjects with Familial Amyloid Polyneuropathy. However, there is still a need to provide patients with additional and more potent treatment options.

Certain Conjugated Antisense Compounds Targeted to a TTR Nucleic Acid

In certain embodiments, conjugated antisense compounds are targeted to a TTR nucleic acid having the sequence of GENBANK® Accession No. NM_000371.3, incorporated herein as SEQ ID NO: 16. In certain such embodiments, a conjugated antisense compound targeted to SEQ ID NO: 16 is at least 90%, at least 95%, or 100% complementary to SEQ ID NO: 16.

In certain embodiments, a conjugated antisense compound targeted to SEQ ID NO: 16 comprises an at least 8 consecutive nucleobase sequence of SEQ ID NOs: 74-81. In certain embodiments, a conjugated antisense compound targeted to SEQ ID NO: 16 comprises a nucleobase sequence of SEQ ID NO: 74-81. In certain embodiments, such conjugated antisense compounds comprise a conjugate comprising 1-3 GalNAc ligands. In certain embodiments, such antisense compounds comprise a conjugate disclosed herein.

TABLE 15

Antisense Compounds targeted to TTR SEQ ID NO: 16

| ISIS No | Target Start Site | Sequence (5'-3') | Motif | SEQ ID NO |
|---|---|---|---|---|
| 420915 | 508 | TCTTGGTTAC ATGAAATCCC | eeeeeddddd dddddeeeee | 74 |
| 304299 | 507 | CTTGGTTACA TGAAATCCCA | eeeeeddddd dddddeeeee | 75 |
| 420921 | 515 | GGAATACTCT TGGTTACATG | eeeeeddddd dddddeeeee | 76 |
| 420922 | 516 | TGGAATACTC TTGGTTACAT | eeeeeddddd dddddeeeee | 77 |

TABLE 15-continued

Antisense Compounds targeted to TTR SEQ ID NO: 16

| ISIS No | Target Start Site | Sequence (5'-3') | Motif | SEQ ID NO |
|---|---|---|---|---|
| 420950 | 580 | TTTTATTGTC TCTGCCTGGA | eeeeeddddd dddddeeeee | 78 |
| 420955 | 585 | GAATGTTTTA TTGTCTCTGC | eeeeeddddd dddddeeeee | 79 |
| 420957 | 587 | AGGAATGTTT TATTGTCTCT | eeeeeddddd dddddeeeee | 80 |
| 420959 | 589 | ACAGGAATGT TTTATTGTCT | eeeeeddddd dddddeeeee | 81 |

TTR Therapeutic Indications

In certain embodiments, the invention provides methods for using a conjugated antisense compound targeted to a TTR nucleic acid for modulating the expression of TTR in a subject. In certain embodiments, the expression of TTR is reduced.

In certain embodiments, the invention provides methods for using a conjugated antisense compound targeted to a TTR nucleic acid in a pharmaceutical composition for treating a subject. In certain embodiments, the subject has a transthyretin related disease, disorder or condition, or symptom thereof. In certain embodiments, the transthyretin related disease, disorder or condition is transthyretin amyloidosis. "Transthyretin-related amyloidosis" or "transthyretin amyloidosis" or "Transthyretin amyloid disease", as used herein, is any pathology or disease associated with dysfunction or dysregulation of transthyretin that result in formation of transthyretin-containing amyloid fibrils. Transthyretin amyloidosis includes, but is not limited to, hereditary TTR amyloidosis, leptomeningeal amyloidosis, familial amyloid polyneuropathy (FAP), familial amyloid cardiomyopathy, familial oculoleptomeningeal amyloidosis, senile cardiac amyloidosis, or senile systemic amyloidosis.

In certain embodiments, the invention provides methods for using a conjugated antisense compound targeted to a TTR nucleic acid in the preparation of a medicament.

15. PCSK9

PCSK9 (also known as Proprotein convertase subtilisin kexin 9) is a member of the subtilisin serine protease family. The other eight mammalian subtilisin proteases, PCSK1-PCSK8 (also called PC1/3, PC2, furin, PC4, PC5/6, PACE4, PC7, and S1P/SKI-1) are proprotein convertases that process a wide variety of proteins in the secretory pathway and play roles in diverse biological processes (Bergeron, F. (2000) J. Mol. Endocrinol. 24, 1-22, Gensberg, K., (1998) Semin Cell Dev. Biol. 9, 11-17, Seidah, N. G. (1999) Brain Res. 848, 45-62, Taylor, N. A., (2003) FASEB J. 17, 1215-1227, and Zhou, A., (1999) J. Biol. Chem. 274, 20745-20748). PCSK9 has been proposed to play a role in cholesterol metabolism. PCSK9 mRNA expression is down-regulated by dietary cholesterol feeding in mice (Maxwell, K. N., (2003) J. Lipid Res. 44, 2109-2119), up-regulated by statins in HepG2 cells (Dubuc, G., (2004) Arterioscler. Thromb. Vasc. Biol. 24, 1454-1459), and up-regulated in sterol regulatory element binding protein (SREBP) transgenic mice (Horton, J. D., (2003) Proc. Natl. Acad. Sci. USA 100, 12027-12032), similar to the cholesterol biosynthetic enzymes and the low-density lipoprotein receptor (LDLR). Furthermore, PCSK9 missense mutations have been found to be associated with a form of autosomal dominant hypercholesterolemia (Hchola3)

(Abifadel, M., et al. (2003) Nat. Genet. 34, 154-156, Timms, K. M., (2004) Hum. Genet. 114, 349-353, Leren, T. P. (2004) Clin. Genet. 65, 419-422). PCSK9 may also play a role in determining LDL cholesterol levels in the general population, because single-nucleotide polymorphisms (SNPs) have been associated with cholesterol levels in a Japanese population (Shioji, K., (2004) J. Hum. Genet. 49, 109-114).

Antisense compounds targeting PCSK9 have been previously disclosed in U.S. Pat. Nos. 8,084,437; 8,093,222; 8,664,190; and International applications WO 2008/066776 and WO 2009/148605. However, there is still a need to provide patients with additional and more potent treatment options.

Certain Conjugated Antisense Compounds Targeted to a PCSK9 Nucleic Acid

In certain embodiments, conjugated antisense compounds are targeted to a PCSK9 nucleic acid having the sequence of GENBANK® Accession, incorporated herein as SEQ ID NO: 160. In certain such embodiments, a conjugated antisense compound targeted to SEQ ID NO: 160 is at least 90%, at least 95%, or 100% complementary to SEQ ID NO: 160.

In certain embodiments, a conjugated antisense compound targeted to SEQ ID NO: 160 comprises an at least 8 consecutive nucleobase sequence of SEQ ID NOs: 156-159. In certain embodiments, a conjugated antisense compound targeted to SEQ ID NO: 160 comprises a nucleobase sequence of SEQ ID NO: 156-159. In certain embodiments, such conjugated antisense compounds comprise a conjugate comprising 1-3 GalNAc ligands. In certain embodiments, such antisense compounds comprise a conjugate disclosed herein.

TABLE 15

Antisense Compounds targeted to PCSK9 SEQ ID NO: 156

| ISIS No | Target Start Site | Sequence (5'-3') | Motif | SEQ ID NO |
|---|---|---|---|---|
| 405879 | 1073 | CCTTGGCCAC GCCGGCATCC | eeeeeddddd ddddddeeeee | 156 |
| 431131 | 1015 | GTCACACTTG CTGGCCTGTC | eeeeeddddd ddddddeeeee | 157 |

TABLE 15-continued

Antisense Compounds targeted to PCSK9 SEQ ID NO: 156

| ISIS No | Target Start Site | Sequence (5'-3') | Motif | SEQ ID NO |
|---|---|---|---|---|
| 405995 | 2001 | TGGCAGTGGA CACGGGTCCC | eeeeeddddd ddddddeeeee | 158 |
| 480604 | 3381 | ACTCACCGAG CTTCCTGGTC | eeeeeddddd ddddddeeeee | 159 |

PCSK9 Therapeutic Indications

In certain embodiments, the invention provides methods for using a conjugated antisense compound targeted to a PCSK9 nucleic acid for modulating the expression of PCSK9 in a subject. In certain embodiments, the expression of PCSK9 is reduced.

In certain embodiments, the invention provides methods for using a conjugated antisense compound targeted to a PCSK9 nucleic acid in a pharmaceutical composition for treating a subject. In certain embodiments, the subject has a PCSK9 related disease, disorder or condition, or symptom thereof. In certain embodiments, the PCSK9 related disease, disorder or condition is a metabolic or cardiovascular disease.

In certain embodiments, the invention provides methods for using a conjugated antisense compound targeted to a PCSK9 nucleic acid in the preparation of a medicament.

E. Certain Nucleic Acid GalNAc Conjugates

In certain embodiments, conjugated antisense compounds comprise antisense compounds having the nucleobase sequence of the antisense compounds in Table 16 below attached to a GalNAc conjugate. In certain embodiments, conjugated antisense compounds comprise antisense compounds having the nucleobase sequence and chemical modifications of the antisense compounds in Table 16 below attached to a GalNAc conjugate. All internucleoside linkages are phosphorothioate internucleoside linkages unless otherwise indicated. A subscript "l" indicates an LNA bicyclic nucleoside. A subscript "d" indicates a 2'-deoxy nucleoside. A subscript "e" indicates a 2'-MOE modified nucleoside. A subscript "v" indicates a 2-amino-2'-deoxyadenosine.

TABLE 16

| Sequence 5' to 3' | Target | Motif | Chemistry | Internucleoside Linkages | SEQ ID NO. |
|---|---|---|---|---|---|
| $T_lG_lC_dA_dA_dG_dC_dA_dT_dC_dC_dT_lG_lT_lA_d$ | HIF-1α | 3-9-3-1 | LNA/deoxy | phosphorothioate | 82 |
| $C_lT_lC_lA_lA_dT_dC_dC_dA_dT_dG_dG_dC_lA_lG_lC_d$ | Survivin | 4-8-3-1 | LNA/deoxy | phosphorothioate | 83 |
| $A_lC_lC_lA_dA_dG_dT_dT_dC_dT_dT_dC_dA_lG_lC_l$ | Androgen Receptor | 3-10-3 | LNA/deoxy | phosphorothioate | 84 |
| $G_lC_lA_dT_dT_dG_dG_dT_dA_dT_dT_lC_lA_l$ | ApoB | 2-8-3 | LNA/deoxy | phosphorothioate | 85 |
| $T_lT_lC_lA_lG_lC_dA_dT_dT_dG_dG_dT_dA_dT_dT_dC_lA_lG_lT_lG_l$ | ApoB | 5-10-5 | LNA/deoxy | phosphorothioate | 86 |
| $C_lA_lG_lC_dA_dT_dT_dG_dG_dT_dA_dT_dT_lC_lA_lG_d$ | ApoB | 3-10-3 | LNA/deoxy | phosphorothioate | 87 |
| $C_lA_lG_lC_dA_dT_dT_dG_dG_dT_dA_dT_dT_lC_lA_l$ | ApoB | 3-9-3 | LNA/deoxy | phosphorothioate | 88 |
| $A_lG_lC_dA_dT_dT_dG_dG_dT_dA_dT_dT_lC_lA_l$ | ApoB | 3-8-3 | LNA/deoxy | phosphorothioate | 89 |
| $G_lC_lA_dT_dT_dG_dG_dT_dA_dT_dT_lC_l$ | ApoB | 2-8-2 | LNA/deoxy | phosphorothioate | 90 |
| $T_lG_lC_lT_dA_dC_dA_dA_dA_dA_dC_dC_lC_lA_l$ | PCSK9 | 3-8-3 | LNA/deoxy | phosphorothioate | 135 |
| $C_lcC_dA_lT_dT_dG_lT_lC_dA_dC_lA_dC_lT_dC_lC_l$ | miR-122 | | LNA/deoxy | phosphorothioate | 136 |

TABLE 16-continued

| Sequence 5' to 3' | Target | Motif | Chemistry | Internucleoside Linkages | SEQ ID NO. |
|---|---|---|---|---|---|
| CGGCATGTCTATTTTGTA | TGF-β2 | | | phosphorothioate | 91 |
| GGCTAAATCGCTCCACCAAG | RRM2 | | | phosphorothioate | 92 |
| CTCTAGCGTCTTAAAGCCGA | RRM1 | | | phosphorothioate | 93 |
| GCTGCATGATCTCCTTGGCG | AKT-1 | | | phosphorothioate | 94 |
| ACGTTGAGGGGCATCGTCGC | c-Myc | | | Morpholino | 95 |
| CGGTTAGAAGACTCATCTTT | Influenza PB1-AUG | | | Morpholino | 137 |
| CTCCAACATCAAGGAAGATGGCATTTCTAG | dystrophin | | | Morpholino | 138 |
| GAATATTAACANACTGACAAGTC | Marburg virus NP | | | Morpholino | 139 |
| CGTTGATANTTCTGCCATNCT | Marburg virus VP24 | | | Morpholino | 140 |
| GCCATGGTTTTTTCTCAGG | Ebola virus VP24 | | | Morpholino | 141 |
| CCTGCCCTTTGTTCTAGTTG | Ebola virus VP35 | | | Morpholino | 142 |
| GGGTCTGCA$_v$GCGGGA$_v$TGGT | CCR3 & CSF2RB | | | phosphorothioate | 96 |
| GTTA$_v$CTA$_v$CTTCCA$_v$CCTGCCTG | CCR3 & CSF2RB | | | phosphorothioate | 97 |
| TATCCGGAGGGCTCGCCATGCTGCT | IRS-1 | | | phosphorothioate | 98 |
| GTCGCCCCTTCTCCCCGCAGC | Smad7 | | | phosphorothioate | 143 |
| GGACCCTCCTCCGGAGCC | IGF-1R | | | phosphorothioate | 144 |
| ACCAGGCGTCTCGTGGGCA | Ki-67 | | | phosphorothioate | 145 |
| TCTCCCAGCGTGCGCCAT | BCL-2 | | | phosphorothioate | 146 |
| GTGCTCCATTGATGC | c-Raf | | | phosphate | 147 |
| $T_eC_eC_eC_eG_eC_e$CTGTGACAT$_eG_eC_eA_eT_eT_e$ | c-Raf | 6-8-6 | MOE/deoxy | | 99 |
| $C_eA_eG_eC_e$AGCAGAGTCTTCAT$_eC_eA_eT_e$ | Clusterin | 4-13-4 | MOE/deoxy | | 100 |
| $G_eG_eG_eA_eC_dG_dC_dG_dC_dG_dT_dC_dG_dG_dT_eC_eA_eT_e$ | HSPB1 | 4-12-4 | MOE/deoxy | | 101 |
| $C_eC_eA_eC_eA_dA_dG_dC_dT_dG_dT_dC_dC_dA_dA_dG_dT_eC_eT_eA_eA_e$ | CTGF | 5-10-5 | MOE/deoxy | | 102 |
| $C_eC_eG_eC_dA_dG_dC_dA_dA_dT_dG_dC_dG_dC_eC_eT_eC_eT_eG_eG_e$ | CD49d/VLA-4 | 3-9-8 | MOE/deoxy | | 103 |
| $T_eC_eA_eG_eG_eG_dC_dA_dT_dT_dC_dT_dT_dC_dA_dC_eA_eT_eT_eC_e$ | GHR | 5-10-5 | MOE/deoxy | | 148 |
| $C_eG_eA_eA_eG_eG_dA_dA_dA_dC_dA_dA_dT_dA_dC_dT_eC_eC_eC_eG_eA_e$ | IGF-1R | 5-10-5 | MOE/deoxy | | 149 |
| $G_eA_eC_eA_eG_eC_dA_dG_dC_dC_dG_dC_dA_dG_dC_dA_eG_eA_eA_eA_e$ | hepcidin | 5-10-5 | MOE/deoxy | | 150 |
| $T_eG_eG_eA_eA_eA_dG_dG_dC_dT_dT_dA_dT_dA_dC_dC_eC_eC_eT_eC_e$ | IL-4Rα1 | 5-10-5 | MOE/deoxy | | 151 |
| TCAAGGAAGATGGCATTTCT | dystrophin | | 2'O-Methyl | phosphorothioate | 152 |
| GUGGCUAACAGAAGCU | dystrophin | | 2'O-Methyl | phosphorothioate | 153 |
| UUUGCCGCUGCCCAAUGCCAUCCUG | dystrophin | | 2'O-Methyl | phosphorothioate | 154 |
| $G_mC_mG_mU_mG_dC_dC_dT_dC_dC_dT_dC_dA_dC_dA_dU_mG_mG_mC_m$ | Protein kinase A | 4-10-4 | 2'-Methyl/deoxy | phosphorothioate | 155 |

Additional Sequences and Oligonucleotides Suitable for Conjugation with any Conjugate Herein In certain embodiments, a compound comprises an antisense oligonucleotide targeted to eukaryotic Initiation Factor 4E (eIF4E) known in the art and a conjugate group described herein. In certain embodiments, antisense oligonucleotides targeted to dIF4E are RNAi (siRNA or ssRNA) compounds. In certain embodiments, antisense oligonucleotides targeted to dIF4E are RNase H based antisense compounds. Examples of antisense oligonucleotides targeted to eIF4E suitable for conjugation include but are not limited to those disclosed in U.S. Pat. No. 7,425,544, which is incorporated by reference in its entirety herein. In certain embodiments, a compound comprises an antisense oligonucleotide having a nucleobase sequence of any of SEQ ID NOs: 18-122 disclosed in U.S. Pat. No. 7,425,544 and a conjugate group described herein. In certain embodiments, a compound comprises an antisense strand having a nucleobase sequence of any of SEQ ID NOs: 212-459 disclosed in U.S. Pat. No. 7,425,544 and a conjugate group described herein. The nucleobase sequences of all of the aforementioned referenced SEQ ID NOs are incorporated by reference herein.

In certain embodiments, a compound comprises an antisense oligonucleotide targeted to Signal Transducer and Activator of Transcription 3 (STAT3) known in the art and a conjugate group described herein. In certain embodiments, antisense oligonucleotides targeted to STAT3 are RNAi (siRNA or ssRNA) compounds. In certain embodiments, antisense oligonucleotides targeted to STAT3 are RNase H based antisense compounds. Examples of antisense oligonucleotides targeted to STAT3 suitable for conjugation include but are not limited to those disclosed in WO 2012/135736, WO 2005/083124, and U.S. Pat. No. 6,727,064; which are incorporated by reference in their entireties herein. In certain embodiments, a compound comprises an antisense oligonucleotide having a nucleobase sequence of any of SEQ ID NOs: 9-426, 430-442, 445-464, 471-498, 500-1034, 1036-1512, and 1541-2757 disclosed in WO 2012/135736 and a conjugate group described herein. In certain embodiments, a compound comprises an antisense oligonucleotide having a nucleobase sequence of any of SEQ ID NOs: 2-81, 108-150, and 159-381 disclosed in WO 2005/083124 and a conjugate group described herein. In certain embodiments, a compound comprises an antisense oligonucleotide having a nucleobase sequence of any of SEQ ID NOs: 2-81 and 108-150 disclosed in U.S. Pat. No. 6,727,064 and a conjugate group described herein. The nucleobase sequences of all of the aforementioned referenced SEQ ID NOs are incorporated by reference herein.

In certain embodiments, a compound comprises an antisense oligonucleotide targeted to glucocorticoid receptor (GCCR) known in the art and a conjugate group described herein. In certain embodiments, antisense oligonucleotides targeted to GCCR are RNAi (siRNA or ssRNA) compounds. In certain embodiments, antisense oligonucleotides targeted to GCCR are RNase H based antisense compounds. Examples of antisense oligonucleotides targeted to GCCR suitable for conjugation include but are not limited to those disclosed in WO 2005/071080, WO 2007/035759, and WO 2007/136988; which are incorporated by reference in their entireties herein. In certain embodiments, a compound comprises an antisense oligonucleotide having a nucleobase sequence of any of SEQ ID NOs: 30-216, and 306-310 disclosed in WO 2005/071080 and a conjugate group described herein. In certain embodiments, a compound comprises an antisense oligonucleotide having a nucleobase sequence of any of SEQ ID NOs: 26-113 disclosed in WO 2007/035759 and a conjugate group disclosed herein. In certain embodiments, a compound comprises an antisense oligonucleotide having a nucleobase sequence of any of SEQ ID NOs: 413-485 disclosed in WO 2007/136988 and a conjugate group disclosed herein. The nucleobase sequences of all of the aforementioned referenced SEQ ID NOs are incorporated by reference herein.

In certain embodiments, a compound comprises an antisense oligonucleotide targeted to glucagon receptor (GCGR) known in the art and a conjugate group described herein. In certain embodiments, antisense oligonucleotides targeted to GCGR are RNAi (siRNA or ssRNA) compounds. In certain embodiments, antisense oligonucleotides targeted to GCGR are RNase H based antisense compounds. Examples of antisense oligonucleotides targeted to GCGR suitable for conjugation include but are not limited to those disclosed in U.S. Pat. No. 7,750,142; U.S. Pat. No. 7,399,853; WO 2007/035771; and WO 2007/134014; which are incorporated by reference in their entireties herein. In certain embodiments, a compound comprises an antisense oligonucleotide having a nucleobase sequence of any of SEQ ID NOs: 20-399 disclosed in U.S. Pat. No. 7,750,142 and a conjugate group described herein. In certain embodiments, a compound comprises an antisense oligonucleotide having a nucleobase sequence of any of SEQ ID NOs: 20-399 disclosed in U.S. Pat. No. 7,399,853 and a conjugate group described herein. In certain embodiments, a compound comprises an antisense oligonucleotide having a nucleobase sequence of SEQ ID NO: 2 disclosed in WO 2007/035771 and a conjugate group described herein. In certain embodiments, a compound comprises an antisense oligonucleotide having a nucleobase sequence of any of SEQ ID NOs: 486-680 disclosed in WO 2007/134014 and a conjugate group described herein. The nucleobase sequences of all of the aforementioned referenced SEQ ID NOs are incorporated by reference herein.

In certain embodiments, a compound comprises an antisense oligonucleotide targeted to Protein Tyrosine Phosphatase 1B (PTP1B) known in the art and a conjugate group described herein. In certain embodiments, antisense oligonucleotides targeted to PTP1B are RNAi (siRNA or ssRNA) compounds. In certain embodiments, antisense oligonucleotides targeted to PT1B are RNase H based antisense compounds. Examples of antisense oligonucleotides targeted to PTP1B suitable for conjugation include but are not limited to those disclosed in U.S. Pat. No. 7,563,884 and WO 2007/131237, which are incorporated by reference in their entireties herein. In certain embodiments, a compound comprises an antisense oligonucleotide having a nucleobase sequence of any of SEQ ID NOs 17-96 and 244-389 disclosed in U.S. Pat. No. 7,563,884 and a conjugate group described herein. In certain embodiments, a compound comprises an antisense oligonucleotide having a nucleobase sequence of any of SEQ ID NOs 886-1552 disclosed in WO 2007/131237 and a conjugate group described herein. The nucleobase sequences of all of the aforementioned referenced SEQ ID NOs are incorporated by reference herein.

In certain embodiments, a compound comprises an antisense oligonucleotide targeted to Fibroblast Growth Factor Receptor 4 (FGFR4) known in the art and a conjugate group described herein. In certain embodiments, antisense oligonucleotides targeted to FGFR4 are RNAi (siRNA or ssRNA) compounds. In certain embodiments, antisense oligonucleotides targeted to FGFR4 are RNase H based antisense compounds. Examples of antisense oligonucleotides targeted to FGFR4 suitable for conjugation include but are not limited to those disclosed in WO 2009/046141, which is incorporated by reference in its entirety herein. In certain embodiments, a compound comprises an antisense oligonucleotide having a nucleobase sequence of any of SEQ ID NOs 21-24, 28, 29, 36, 38, 39, 43, 48, 51, 54-56, 58-60, 64-66, and 92-166 disclosed in WO 2009/046141 and a conjugate group described herein. The nucleobase sequences of all of the aforementioned referenced SEQ ID NOs are incorporated by reference herein.

In certain embodiments, a compound comprises an antisense oligonucleotide targeted to alpha-1-antitrypsin (A1AT) known in the art and a conjugate group described herein. In certain embodiments, antisense oligonucleotides targeted to A1AT are RNAi (siRNA or ssRNA) compounds. In certain embodiments, antisense oligonucleotides targeted to A1AT are RNase H based antisense compounds. Examples of antisense oligonucleotides targeted to A1AT suitable for conjugation include but are not limited to those disclosed in WO 2013/142514, which is incorporated by reference in its entirety herein. In certain embodiments, a compound comprises an antisense oligonucleotide having a nucleobase sequence of any of SEQ ID NOs 20-41 disclosed in WO 2013/142514 and a conjugate group described herein. The nucleobase sequences of all of the aforementioned referenced SEQ ID NOs are incorporated by reference herein.

In certain embodiments, a compound comprises an antisense oligonucleotide targeted to Factor VII known in the art and a conjugate group described herein. In certain embodiments, antisense oligonucleotides targeted to Factor VII are RNAi (siRNA or ssRNA) compounds. In certain embodiments, antisense oligonucleotides targeted to Factor VII are RNase H based antisense compounds. Examples of antisense oligonucleotides targeted to Factor VII suitable for conjugation include but are not limited to those disclosed in WO 2013/119979 and WO 2009/061851, which are incorporated by reference in their entireties herein. In certain embodiments, a compound comprises an antisense oligonucleotide having a nucleobase sequence of any of SEQ ID NOs 21-659 disclosed in WO 2013/119979 and a conjugate group described herein. In certain embodiments, a compound comprises an antisense oligonucleotide having a nucleobase sequence of any of SEQ ID NOs 4-159 and 168-611 disclosed in WO 2009/061851 and a conjugate group described herein. The nucleobase sequences of all of the aforementioned referenced SEQ ID NOs are incorporated by reference herein.

In certain embodiments, a compound comprises an antisense oligonucleotide targeted to Factor XI known in the art and a conjugate group described herein. In certain embodiments, antisense oligonucleotides targeted to Factor XI are RNAi (siRNA or ssRNA) compounds. In certain embodiments, antisense oligonucleotides targeted to Factor XI are RNase H based antisense compounds. Examples of antisense oligonucleotides targeted to Factor XI suitable for conjugation include but are not limited to those disclosed in WO 2010/045509 and WO 2010/121074, which are incorporated by reference in their entireties herein. In certain embodiments, a compound comprises an antisense oligonucleotide having a nucleobase sequence of any of SEQ ID NOs 15-270 disclosed in WO 2010/045509 and a conjugate group described herein. In certain embodiments, a compound comprises an antisense oligonucleotide having a nucleobase sequence of any of SEQ ID NOs 15-270 disclosed in WO 2010/121074 and a conjugate group described herein. The nucleobase sequences of all of the aforementioned referenced SEQ ID NOs are incorporated by reference herein.

In certain embodiments, a compound comprises an antisense oligonucleotide targeted to Hepatitis B Virus (HBV) known in the art and a conjugate group described herein. In certain embodiments, antisense oligonucleotides targeted to HBV are RNAi (siRNA or ssRNA) compounds. In certain embodiments, antisense oligonucleotides targeted to HBV are RNase H based antisense compounds. Examples of antisense oligonucleotides targeted to HBV suitable for conjugation include but are not limited to those disclosed in WO 2012/145697 and WO 2012/145697, which are incorporated by reference in their entireties herein. In certain embodiments, a compound comprises an antisense oligonucleotide having a nucleobase sequence of any of SEQ ID NOs 5-310, 321-802, 804-1272, 1288-1350, 1364-1372, 1375, 1376, and 1379 disclosed in WO 2012/145697 and a conjugate group described herein. In certain embodiments, a compound comprises an antisense oligonucleotide having a nucleobase sequence of any of SEQ ID NOs 14-22 disclosed in WO 2011/047312 and a conjugate group described herein. The nucleobase sequences of all of the aforementioned referenced SEQ ID NOs are incorporated by reference herein.

In certain embodiments, a compound comprises an antisense oligonucleotide targeted to transthyretin (TTR) known in the art and a conjugate group described herein. In certain embodiments, antisense oligonucleotides targeted to TTR are RNAi (siRNA or ssRNA) compounds. In certain embodiments, antisense oligonucleotides targeted to TTR are RNase H based antisense compounds. Examples of antisense oligonucleotides targeted to TTR suitable for conjugation include but are not limited to those disclosed in WO 2011/139917 and U.S. Pat. No. 8,101,743, which are incorporated by reference in their entireties herein. In certain embodiments, a compound comprises an antisense oligonucleotide having a nucleobase sequence of any of SEQ ID NOs 8-160, 170-177 disclosed in WO 2011/139917 and a conjugate group described herein. In certain embodiments, a compound comprises an antisense oligonucleotide having a nucleobase sequence of any of SEQ ID NOs 12-89 disclosed in U.S. Pat. No. 8,101,743 and a conjugate group described herein. In certain embodiments, a compound comprises an antisense oligonucleotide having a nucleobase sequence complementary to a preferred target segment of any of SEQ ID NOs 90-133 disclosed in U.S. Pat. No. 8,101,743 and a conjugate group described herein. The nucleobase sequences of all of the aforementioned referenced SEQ ID NOs are incorporated by reference herein.

In certain embodiments, a compound comprises an antisense oligonucleotide targeted to apolipoprotein(a) (apo(a)) known in the art and a conjugate group described herein. In certain embodiments, antisense oligonucleotides targeted to apo(a) are RNAi (siRNA or ssRNA) compounds. In certain embodiments, antisense oligonucleotides targeted to apo(a) are RNase H based antisense compounds. Examples of antisense oligonucleotides targeted to apo(a) suitable for conjugation include but are not limited to those disclosed in WO 2013/177468; U.S. Pat. No. 8,673,632; U.S. Pat. No. 7,259,150; and US Patent Application Publication No. US 2004/0242516; which are incorporated by reference in their entireties herein. In certain embodiments, a compound comprises an antisense oligonucleotide having a nucleobase sequence of any of SEQ ID NOs 12-130, 133, 134 disclosed in WO 2013/177468 and a conjugate group described herein. In certain embodiments, a compound comprises an antisense oligonucleotide having a nucleobase sequence of any of SEQ ID NOs 11-45 and 85-96 disclosed in U.S. Pat. No. 8,673,632 and a conjugate group described herein. In certain embodiments, a compound comprises an antisense oligonucleotide having a nucleobase sequence of any of SEQ ID NOs 11-45 disclosed in U.S. Pat. No. 7,259,150 and a conjugate group described herein. In certain embodiments, a compound comprises an antisense oligonucleotide having a nucleobase sequence of any of SEQ ID NOs 7-41 disclosed in US Patent Application Publication No. US 2004/0242516 and a conjugate group described herein. The nucleobase sequences of all of the aforementioned referenced SEQ ID NOs are incorporated by reference herein.

In certain embodiments, a compound comprises an antisense oligonucleotide targeted to Apolipoprotein B (ApoB) known in the art and a conjugate group described herein. In certain embodiments, antisense oligonucleotides targeted to ApoB are RNAi (siRNA or ssRNA) compounds. In certain embodiments, antisense oligonucleotides targeted to ApoB are RNase H based antisense compounds. Examples of antisense oligonucleotides targeted to ApoB suitable for conjugation include but are not limited to those disclosed in US Patent Application Publication Nos. US 2010/0331390, US 2009/0306180, and US 2005/0009088; which are incorporated by reference in their entireties herein. In certain embodiments, a compound comprises an antisense oligonucleotide having a nucleobase sequence of SEQ ID NO: 20 disclosed in US 2010/0331390 and a conjugate group described herein. In certain embodiments, a compound comprises an antisense oligonucleotide having a nucleobase sequence of any of SEQ ID NOs 16-213 disclosed in US 2009/0306180 and a conjugate group described herein. In certain embodiments, a compound comprises an antisense oligonucleotide having a nucleobase sequence of any of SEQ ID NOs 17-70, 124-317, 319-333, 335-502, 504-804, and 864-887 disclosed in US 2005/0009088 and a conjugate group described herein. The nucleobase sequences of all of the aforementioned referenced SEQ ID NOs are incorporated by reference herein.

In certain embodiments, a compound comprises an antisense oligonucleotide targeted to Apolipoprotein C-III (ApoC-III) known in the art and a conjugate group described herein. In certain embodiments, antisense oligonucleotides targeted to ApoC-III are RNAi (siRNA or ssRNA) compounds. In certain embodiments, antisense oligonucleotides targeted to ApoC-III are RNase H based antisense compounds. Examples of antisense oligonucleotides targeted to ApoC-III suitable for conjugation include but are not limited to those disclosed in US Patent Application Publication No. US 2013/0317085, which is incorporated by reference in its entirety herein. In certain embodiments, a compound comprises an antisense oligonucleotide having a nucleobase sequence of any of SEQ ID NOs 19-96 and 209-221 disclosed in US 2013/0317085 and a conjugate group described herein. The nucleobase sequences of all of the aforementioned referenced SEQ ID NOs are incorporated by reference herein.

In certain embodiments, a compound comprises an antisense oligonucleotide targeted to proprotein convertase subtilisin/kexin type 9 (PCSK9) known in the art and a conjugate group described herein. In certain embodiments, antisense oligonucleotides targeted to PCSK9 are RNAi (siRNA or ssRNA) compounds. In certain embodiments, antisense oligonucleotides targeted to PCSK9 are RNase H based antisense compounds. Examples of antisense oligonucleotides targeted to PCSK9 suitable for conjugation include but are not limited to those disclosed in U.S. Pat. No. 8,143,230 and U.S. Pat. No. 8,664,190; which are incorporated by reference in their entireties herein. In certain embodiments, a compound comprises an antisense oligonucleotide having a nucleobase sequence of any of SEQ ID NOs 329-403 disclosed in U.S. Pat. No. 8,143,230 and a conjugate group described herein. In certain embodiments, a compound comprises an antisense oligonucleotide having a nucleobase sequence of any of SEQ ID NOs 4-455 and 458-461 disclosed in U.S. Pat. No. 8,664,190 and a conjugate group described herein. The nucleobase sequences of all of the aforementioned referenced SEQ ID NOs are incorporated by reference herein.

In certain embodiments, a compound comprises an antisense oligonucleotide targeted to C-reactive protein (CRP) known in the art and a conjugate group described herein. In certain embodiments, antisense oligonucleotides targeted to CRP are RNAi (siRNA or ssRNA) compounds. In certain embodiments, antisense oligonucleotides targeted to CRP are RNase H based antisense compounds. Examples of antisense oligonucleotides targeted to CRP suitable for conjugation include but are not limited to those disclosed in WO 2003/010284, WO 2005/005599, and WO 2007/143317; which are incorporated by reference in their entireties herein. In certain embodiments, a compound comprises an antisense oligonucleotide having a nucleobase sequence of any of SEQ ID NOs 10-63 disclosed in WO 2003/010284 and a conjugate group described herein. In certain embodiments, a compound comprises an antisense oligonucleotide having a nucleobase sequence of any of SEQ ID NOs 19-72, 76-259, and 598-613 disclosed in WO 2005/005599 and a conjugate group described herein. In certain embodiments, a compound comprises an antisense oligonucleotide having a nucleobase sequence of any of SEQ ID NOs 409-412 disclosed in WO 2007/143317 and a conjugate group described herein. The nucleobase sequences of all of the aforementioned referenced SEQ ID NOs are incorporated by reference herein.

F. Certain Pharmaceutical Compositions

In certain embodiments, the present disclosure provides pharmaceutical compositions comprising one or more antisense compound. In certain embodiments, such pharmaceutical composition comprises a suitable pharmaceutically acceptable diluent or carrier. In certain embodiments, a pharmaceutical composition comprises a sterile saline solution and one or more antisense compound. In certain embodiments, such pharmaceutical composition consists of a sterile saline solution and one or more antisense compound. In certain embodiments, the sterile saline is pharmaceutical grade saline. In certain embodiments, a pharmaceutical composition comprises one or more antisense compound and sterile water. In certain embodiments, a pharmaceutical composition consists of one or more antisense compound and sterile water. In certain embodiments, the sterile saline is pharmaceutical grade water. In certain embodiments, a pharmaceutical composition comprises one or more antisense compound and phosphate-buffered saline (PBS). In certain embodiments, a pharmaceutical composition consists of one or more antisense compound and sterile phosphate-buffered saline (PBS). In certain embodiments, the sterile saline is pharmaceutical grade PBS.

In certain embodiments, antisense compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions comprising antisense compounds encompass any pharmaceutically acceptable salts, esters, or salts of such esters. In certain embodiments, pharmaceutical compositions comprising antisense compounds comprise one or more oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an oligonucleotide which are cleaved by endogenous nucleases within the body, to form the active antisense oligonucleotide.

Lipid moieties have been used in nucleic acid therapies in a variety of methods. In certain such methods, the nucleic acid is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions provided herein comprise one or more modified oligonucleotides and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, a pharmaceutical composition provided herein comprises a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, a pharmaceutical composition provided herein comprises one or more tissue-specific delivery molecules designed to deliver the one or more pharmaceutical agents of the present disclosure to specific tissues or cell types. For example, in certain embodiments, pharmaceutical compositions include liposomes coated with a tissue-specific antibody.

In certain embodiments, a pharmaceutical composition provided herein comprises a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, a pharmaceutical composition provided herein is prepared for oral administration. In certain embodiments, pharmaceutical compositions are prepared for buccal administration.

In certain embodiments, a pharmaceutical composition is prepared for administration by injection (e.g., intravenous, subcutaneous, intramuscular, etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain substances that increase the viscosity of the suspension, such as sodium carboxymethyl cellulose, sorbitol, or dextran. Optionally, such suspensions may also contain suitable stabilizers or agents that increase the solubility of the pharmaceutical agents to allow for the preparation of highly concentrated solutions.

In certain embodiments, a pharmaceutical composition is prepared for transmucosal administration. In certain of such embodiments penetrants appropriate to the barrier to be permeated are used in the formulation. Such penetrants are generally known in the art.

In certain embodiments, a pharmaceutical composition provided herein comprises an oligonucleotide in a therapeutically effective amount. In certain embodiments, the therapeutically effective amount is sufficient to prevent, alleviate or ameliorate symptoms of a disease or to prolong the survival of the subject being treated. Determination of a therapeutically effective amount is well within the capability of those skilled in the art.

In certain embodiments, one or more modified oligonucleotide provided herein is formulated as a prodrug. In certain embodiments, upon in vivo administration, a prodrug is chemically converted to the biologically, pharmaceutically or therapeutically more active form of an oligonucleotide. In certain embodiments, prodrugs are useful because they are easier to administer than the corresponding active form. For example, in certain instances, a prodrug may be more bioavailable (e.g., through oral administration) than is the corresponding active form. In certain instances, a prodrug may have improved solubility compared to the corresponding active form. In certain embodiments, prodrugs are less water soluble than the corresponding active form. In certain instances, such prodrugs possess superior transmittal across cell membranes, where water solubility is detrimental to mobility. In certain embodiments, a prodrug is an ester. In certain such embodiments, the ester is metabolically hydrolyzed to carboxylic acid upon administration. In certain instances the carboxylic acid containing compound is the corresponding active form. In certain embodiments, a prodrug comprises a short peptide (polyaminoacid) bound to an acid group. In certain of such embodiments, the peptide is cleaved upon administration to form the corresponding active form.

In certain embodiments, the present disclosure provides compositions and methods for reducing the amount or activity of a target nucleic acid in a cell. In certain embodiments, the cell is in an animal. In certain embodiments, the animal is a mammal. In certain embodiments, the animal is a rodent. In certain embodiments, the animal is a primate. In certain embodiments, the animal is a non-human primate. In certain embodiments, the animal is a human.

In certain embodiments, the present disclosure provides methods of administering a pharmaceutical composition comprising an oligonucleotide of the present disclosure to an animal. Suitable administration routes include, but are not limited to, oral, rectal, transmucosal, intestinal, enteral, topical, suppository, through inhalation, intrathecal, intracerebroventricular, intraperitoneal, intranasal, intraocular, intratumoral, and parenteral (e.g., intravenous, intramuscular, intramedullary, and subcutaneous). In certain embodiments, pharmaceutical intrathecals are administered to achieve local rather than systemic exposures. For example, pharmaceutical compositions may be injected directly in the area of desired effect (e.g., into the liver).

NONLIMITING DISCLOSURE AND INCORPORATION BY REFERENCE

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Certain compounds, compositions, and methods herein are described as "comprising exactly" or "comprises exactly" a particular number of a particular element or feature. Such descriptions are used to indicate that while the compound, composition, or method may comprise additional other elements, the number of the particular element or feature is the identified number. For example, "a conjugate comprising exactly one GalNAc" is a conjugate that contains one and only one GalNAc, though it may contain other elements in addition to the one GalNAc.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and oligonucleotides having other modified bases, such as "AT$^{me}$CGAUCG," wherein $^{me}$C indicates a cytosine base comprising a methyl group at the 5-position.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif And, for example, where a particular high-affinity modification appears at a particular position, other high-affinity modifications at the same position are considered suitable, unless otherwise indicated.

Examples

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif And, for example, where a particular high-affinity modification appears at a particular position, other high-affinity modifications at the same position are considered suitable, unless otherwise indicated.

Example 1

General Method for the Preparation of Phosphoramidites, Compounds 1, 1a and 2

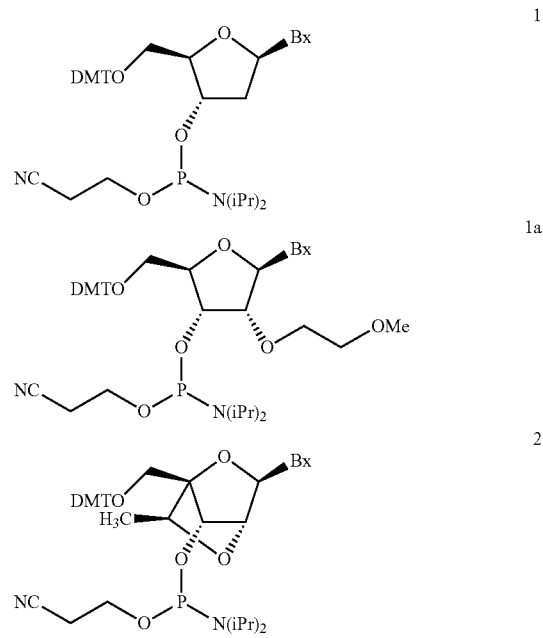

Bx is a heterocyclic base;

Compounds 1, 1a and 2 were prepared as per the procedures well known in the art as described in the specification herein (see Seth et al., Bioorg. Med. Chem., 2011, 21(4), 1122-1125, J. Org. Chem., 2010, 75(5), 1569-1581, Nucleic Acids Symposium Series, 2008, 52(1), 553-554); and also see published PCT International Applications (WO 2011/115818, WO 2010/077578, WO2010/036698, WO2009/143369, WO 2009/006478, and WO 2007/090071), and U.S. Pat. No. 7,569,686).

Example 2

Preparation of Compound 7

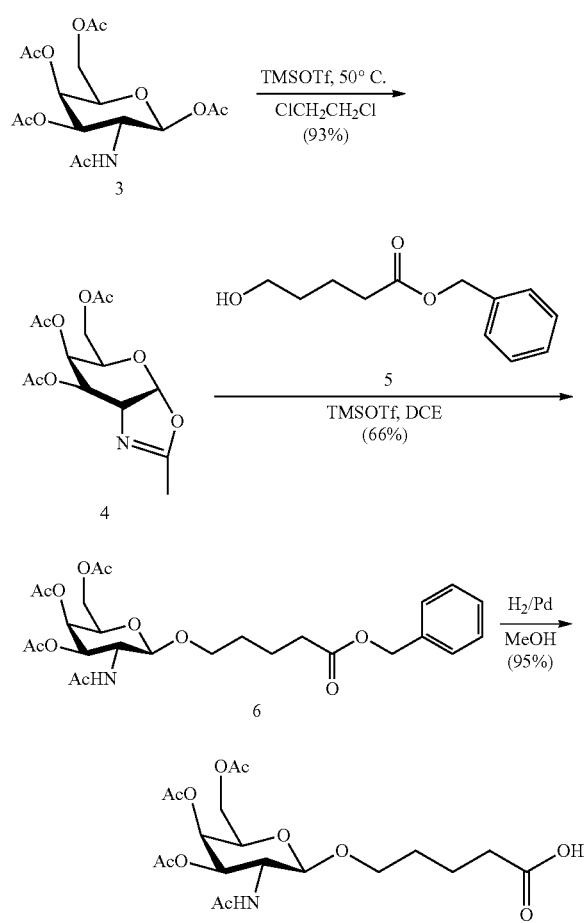

Compounds 3 (2-acetamido-1,3,4,6-tetra-O-acetyl-2-deoxy-β-Dgalactopyranose or galactosamine pentaacetate) is commercially available. Compound 5 was prepared according to published procedures (Weber et al., *J. Med. Chem.*, 1991, 34, 2692).

Example 3

Preparation of Compound 11

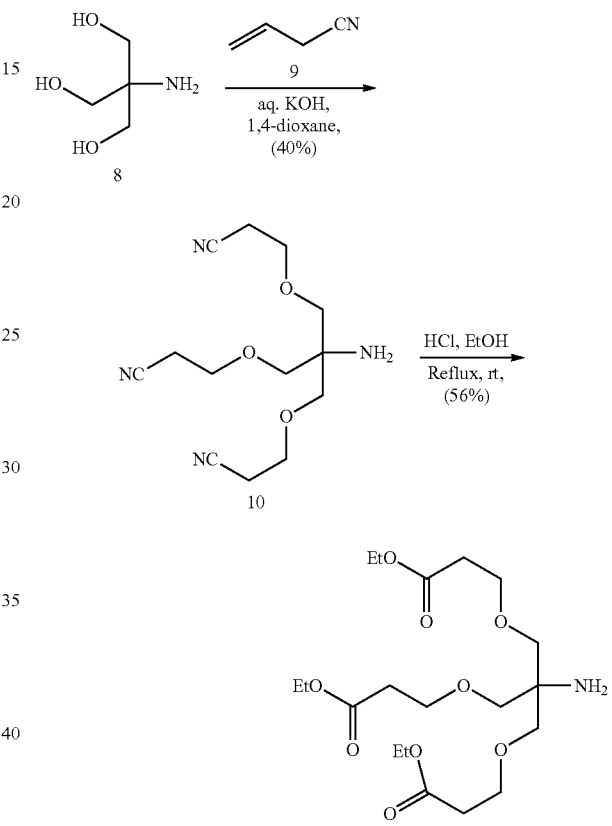

Compounds 8 and 9 are commercially available.

Example 4

Preparation of Compound 18

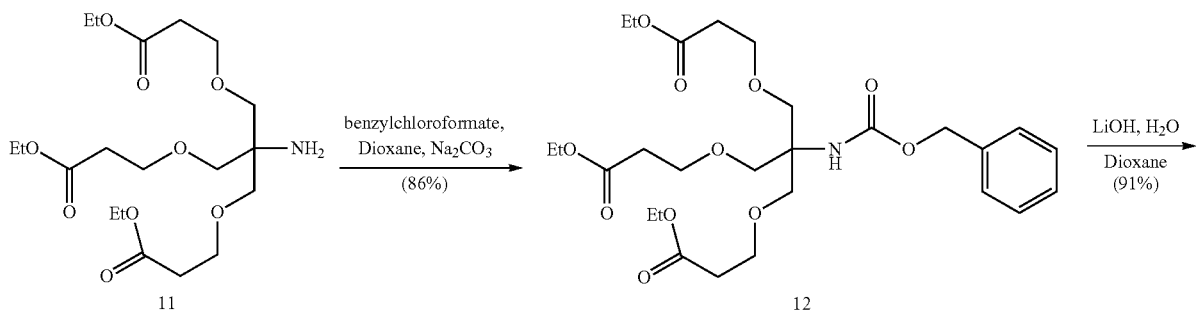

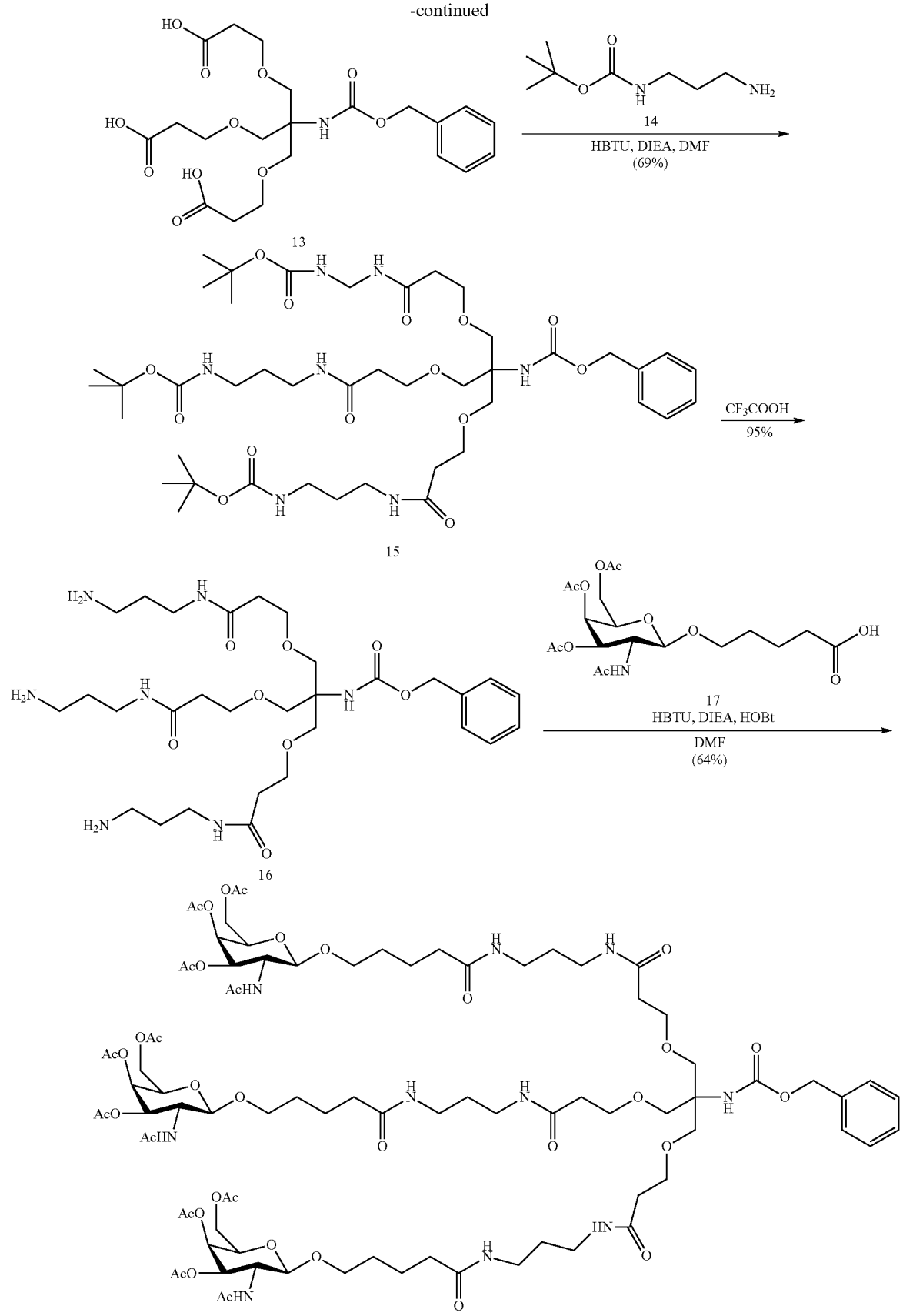

Compound 11 was prepared as per the procedures illustrated in Example 3. Compound 14 is commercially available. Compound 17 was prepared using similar procedures reported by Rensen et al., *J. Med. Chem.*, 2004, 47, 5798-5808.
Example 5
Preparation of Compound 23
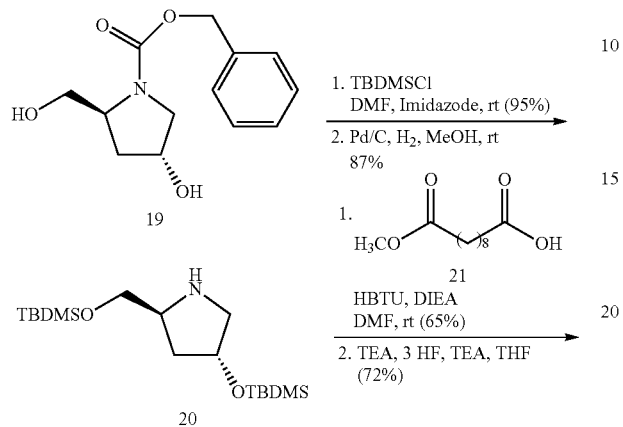
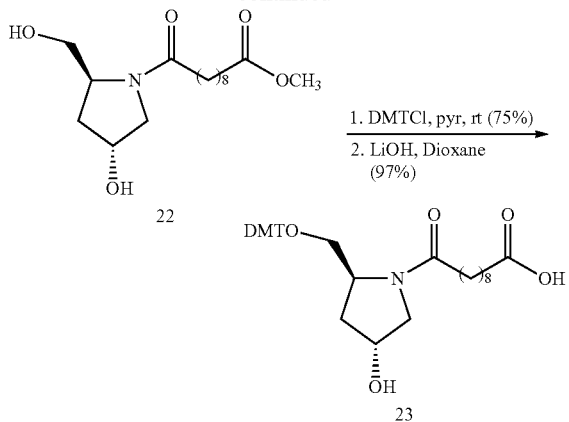
Compounds 19 and 21 are commercially available.
Example 6
Preparation of Compound 24
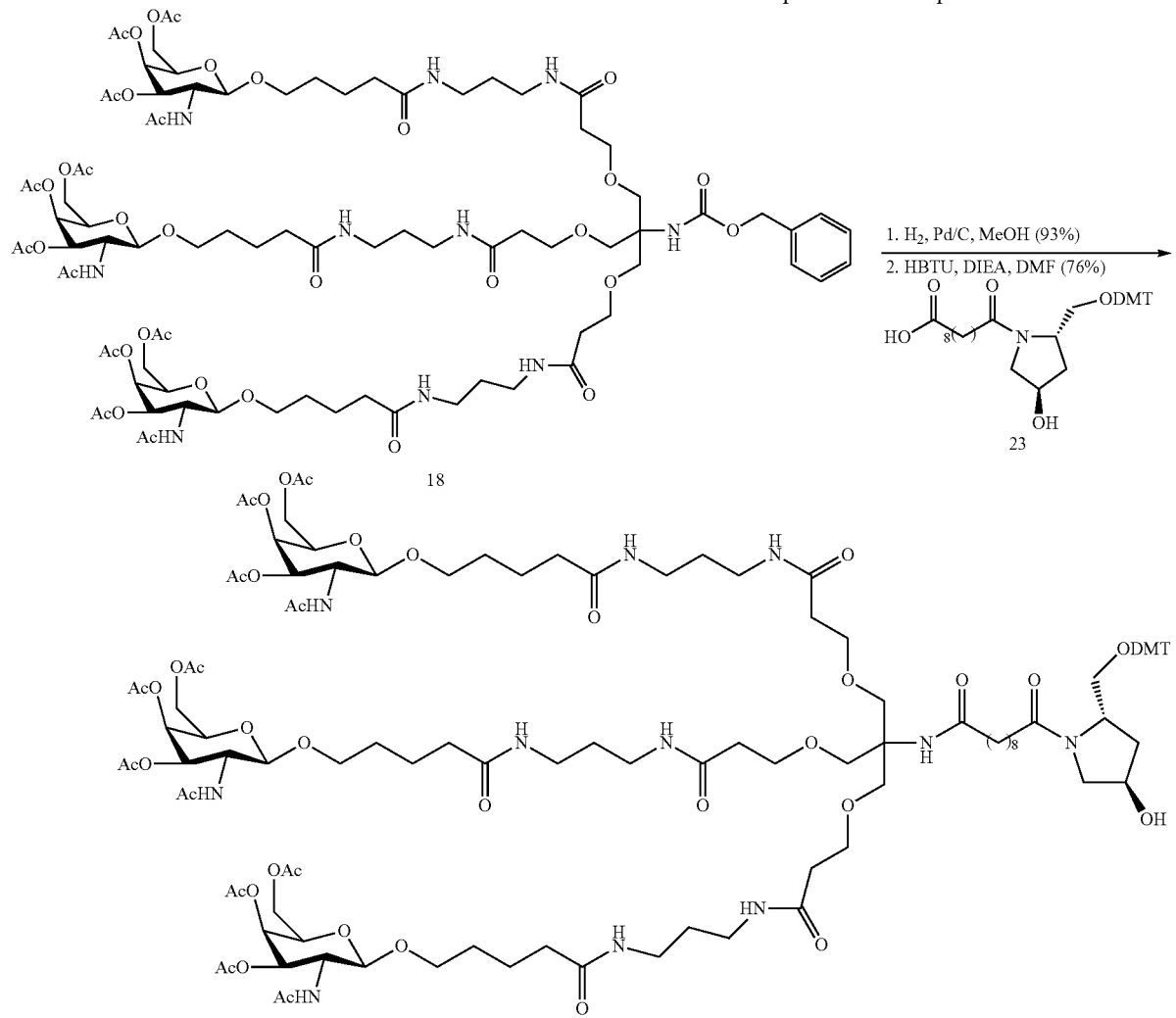

Compounds 18 and 23 were prepared as per the procedures illustrated in Examples 4 and 5.
Example 7
Preparation of Compound 25
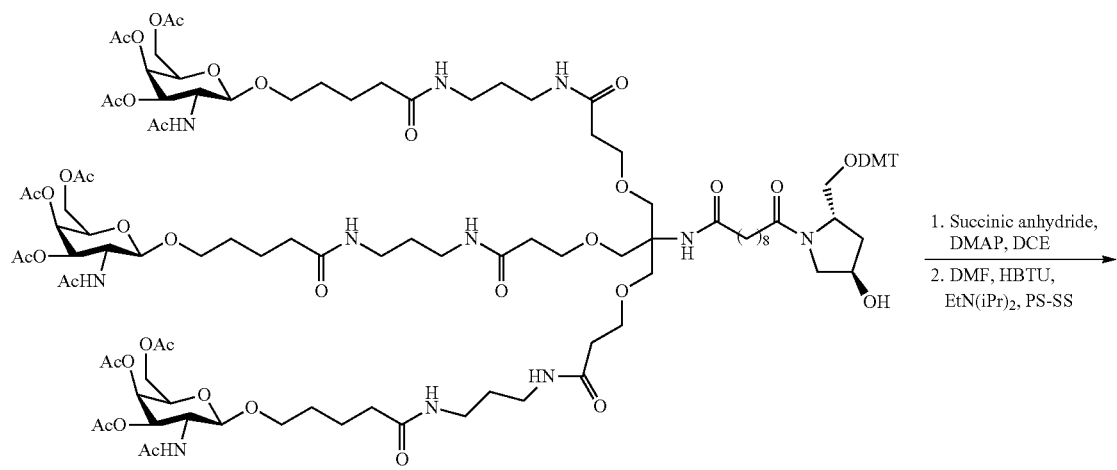
24
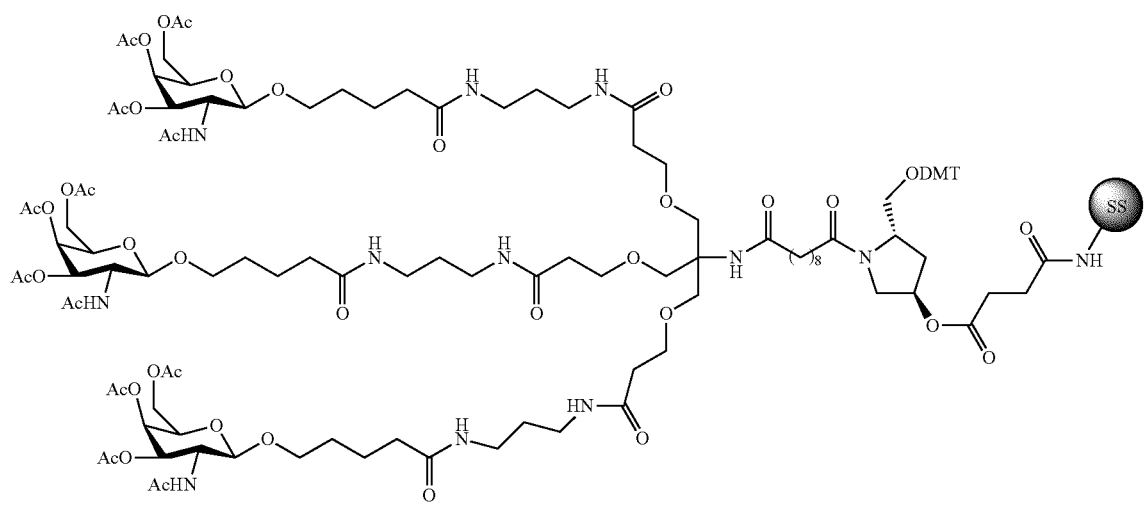
25
Compound 24 was prepared as per the procedures illustrated in Example 6.

Example 8
Preparation of Compound 26
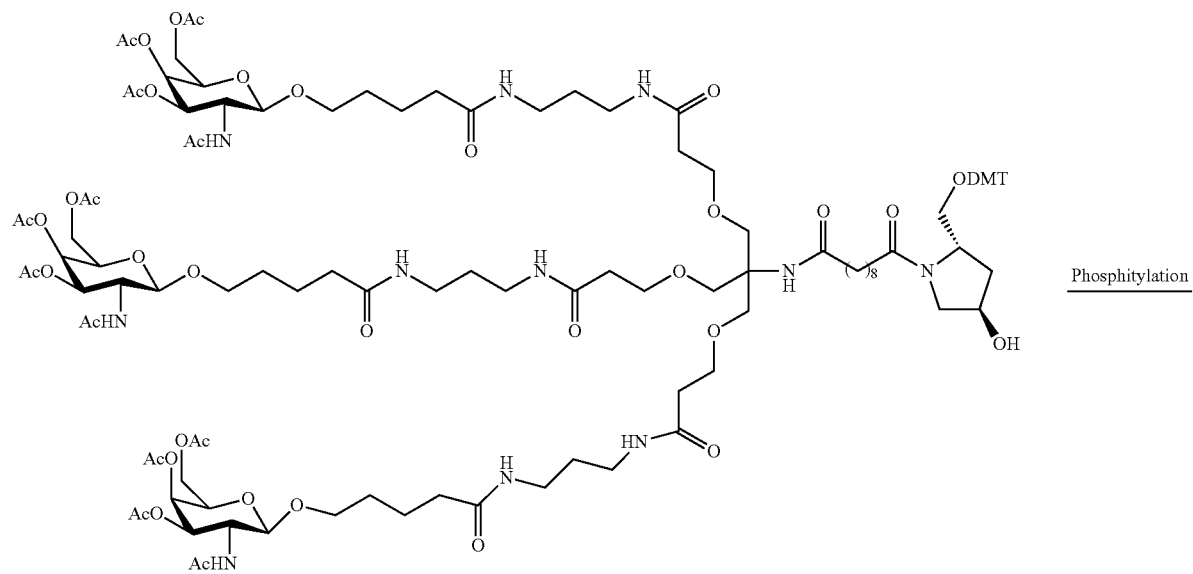
24
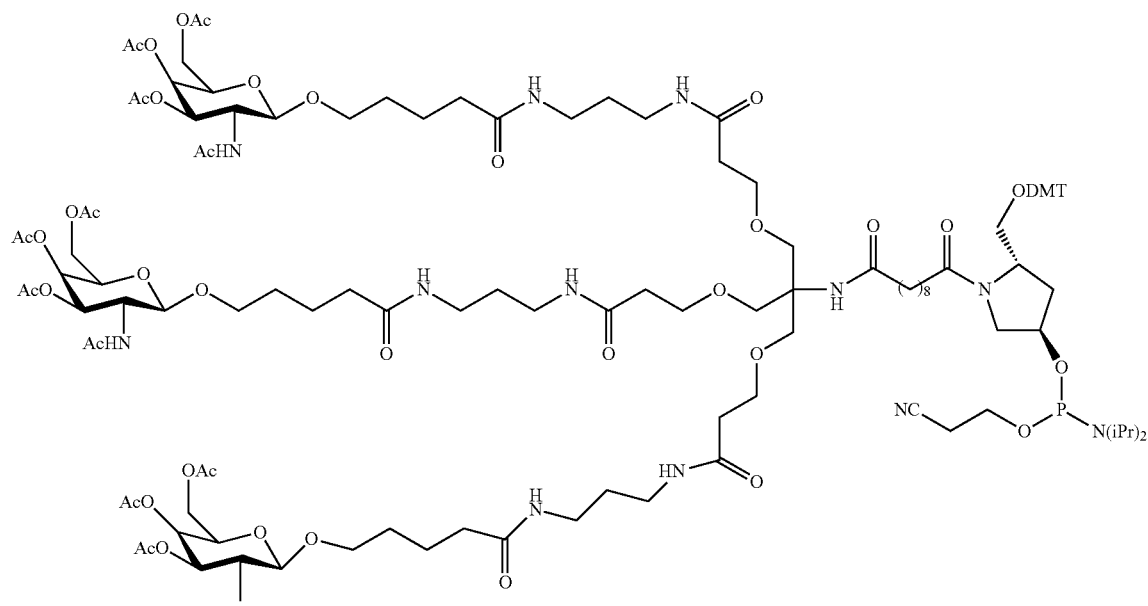
26
Compound 24 is prepared as per the procedures illustrated in Example 6.

Example 9
General Preparation of Conjugated ASOs Comprising GalNAc₃-1 at the 3' Terminus, Compound 29
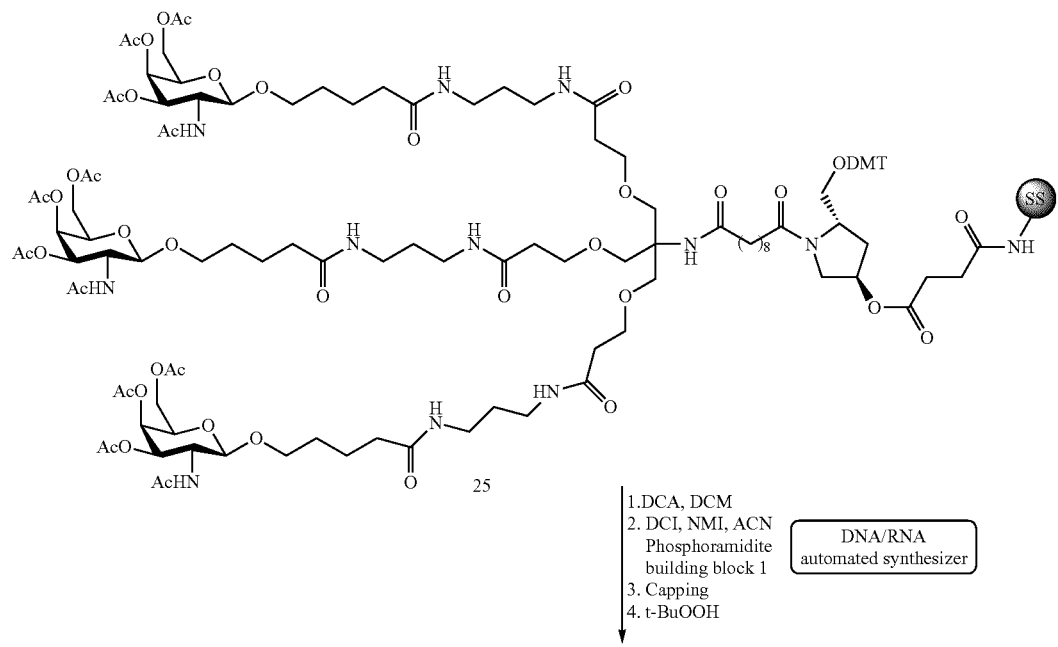
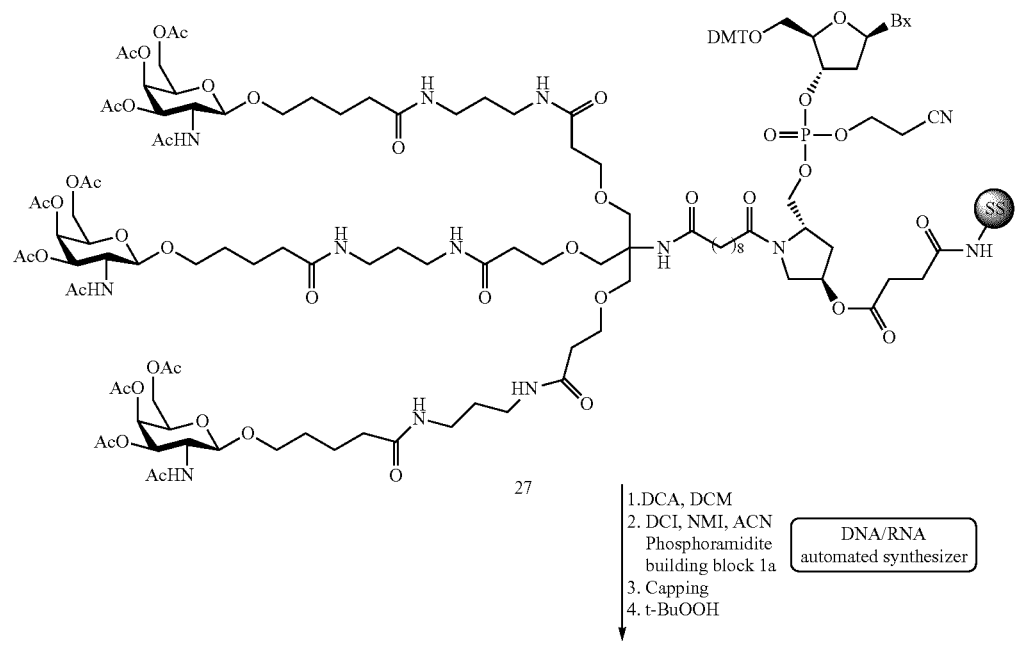

-continued
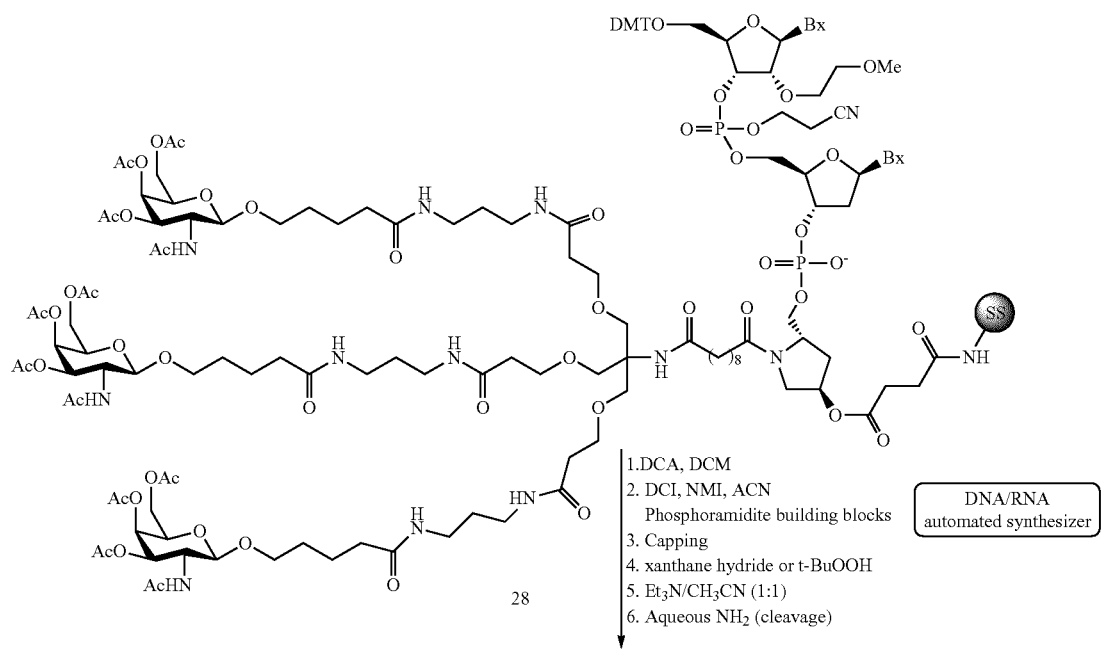
1. DCA, DCM
2. DCI, NMI, ACN
   Phosphoramidite building blocks
3. Capping
4. xanthane hydride or t-BuOOH
5. Et₃N/CH₃CN (1:1)
6. Aqueous NH₂ (cleavage)
DNA/RNA automated synthesizer
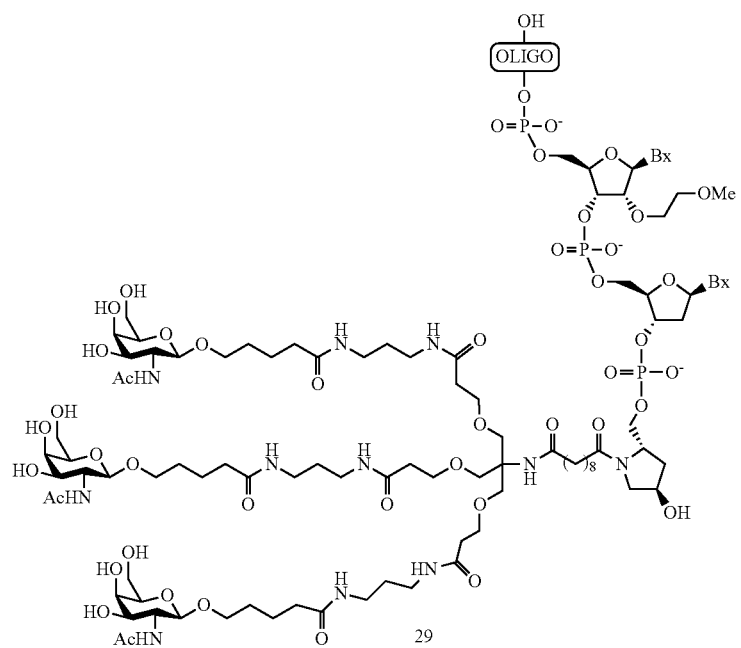
Bx = Heterocyclic base
X = O or S Wherein the protected GalNAc₃-1 has the structure:

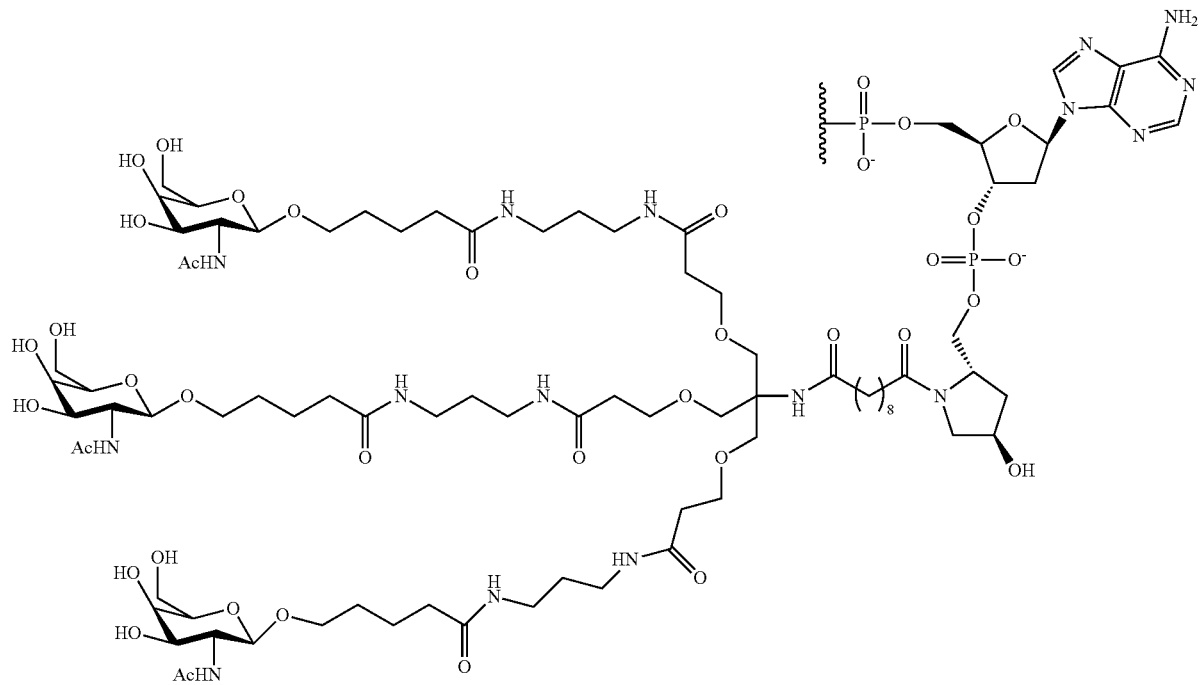

The GalNAc₃ cluster portion of the conjugate group GalNAc₃-1 (GalNAc₃-1$_a$) can be combined with any cleavable moiety to provide a variety of conjugate groups. Wherein GalNAc₃-1$_a$ has the formula:

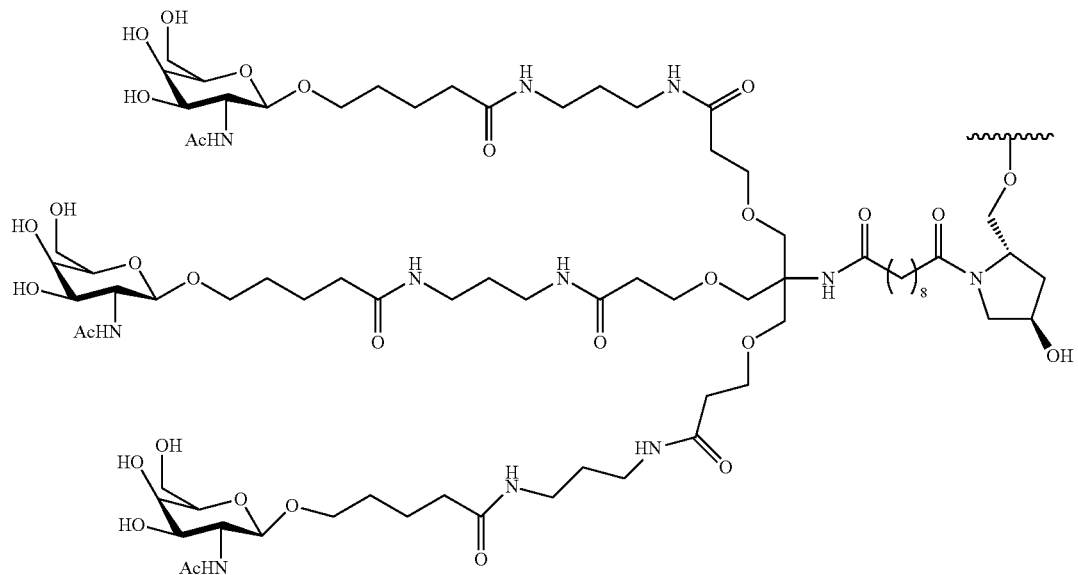

The solid support bound protected GalNAc₃-1, Compound 25, was prepared as per the procedures illustrated in Example 7. Oligomeric Compound 29 comprising GalNAc₃-1 at the 3′ terminus was prepared using standard procedures in automated DNA/RNA synthesis (see Dupouy et al., *Angew. Chem. Int. Ed.*, 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare oligomeric compounds having a predetermined sequence and composition. The order and quantity of phosphoramidites added to the solid support can be adjusted to prepare gapped oligomeric compounds as described herein. Such gapped oligomeric compounds can have predetermined composition and base sequence as dictated by any given target.

Example 10
General Preparation Conjugated ASOs Comprising GalNAc$_3$-1 at the 5' Terminus, Compound 34
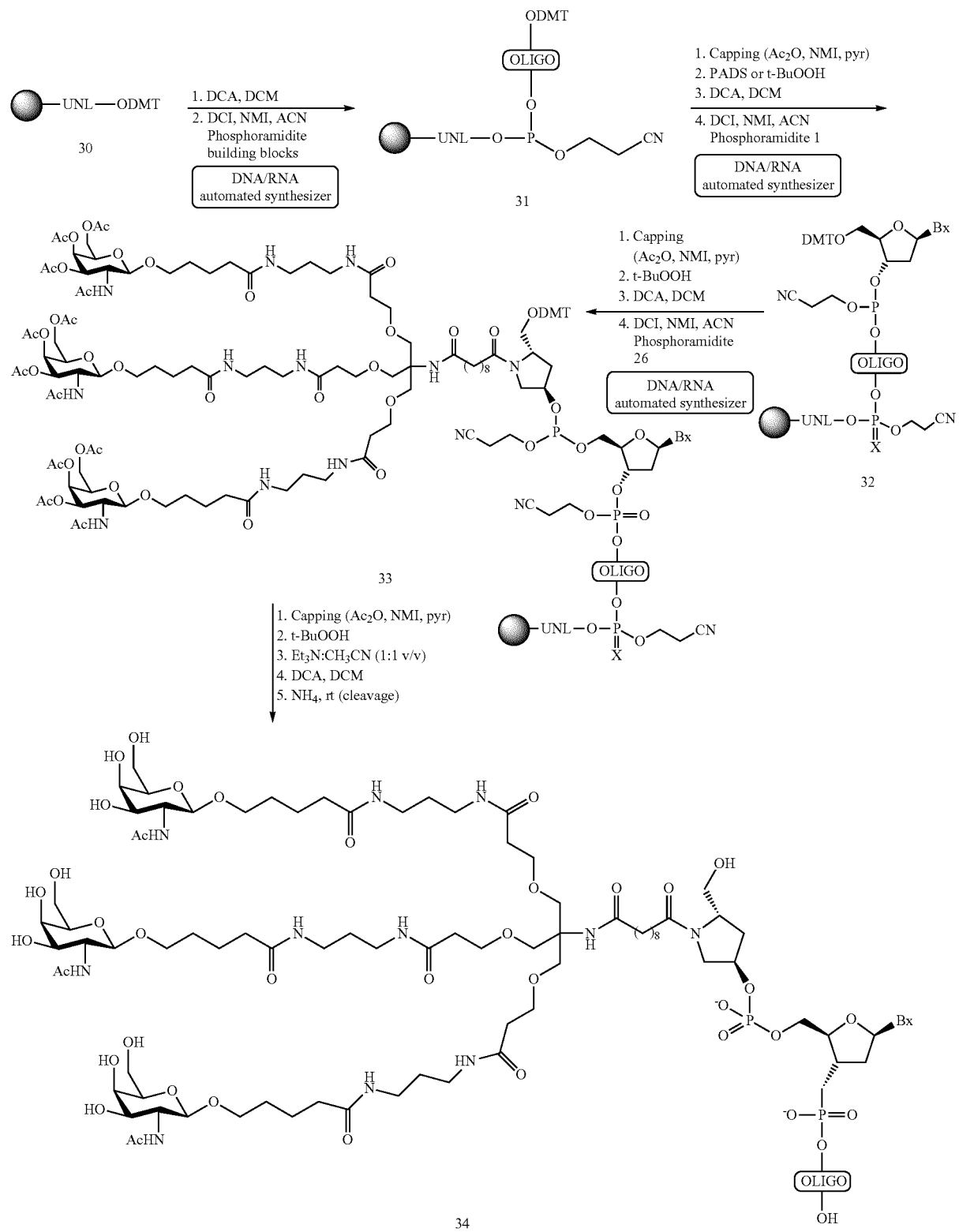
X = O, or S
Bx = Heterocyclic base The Unylinker™ 30 is commercially available. Oligomeric Compound 34 comprising a GalNAc₃-1 cluster at the 5' terminus is prepared using standard procedures in automated DNA/RNA synthesis (see Dupouy et al., *Angew. Chem. Int. Ed.*, 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare an oligomeric compound having a predetermined sequence and composition. The order and quantity of phosphoramidites added to the solid support can be adjusted to prepare gapped oligomeric compounds as described herein. Such gapped oligomeric compounds can have predetermined composition and base sequence as dictated by any given target.

Example 11

Preparation of Compound 39

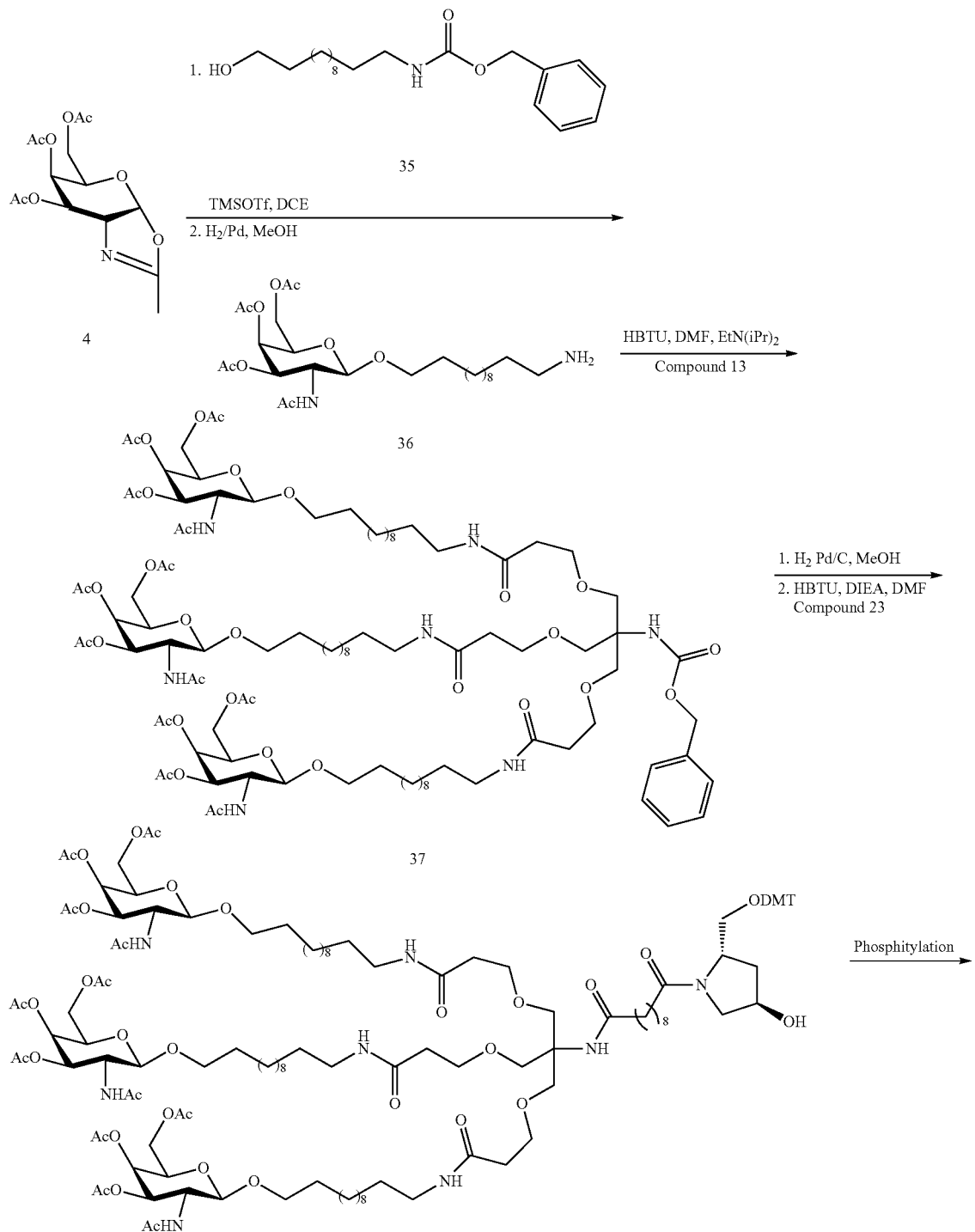

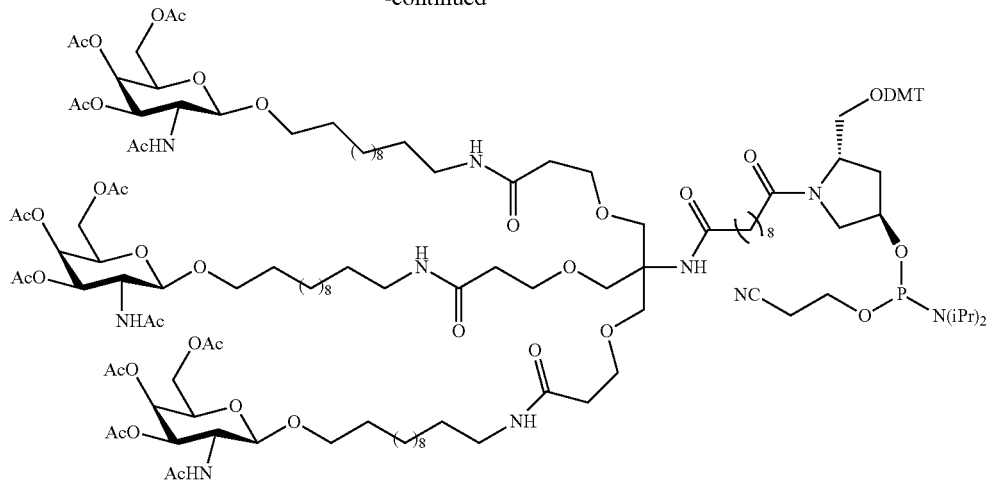
39
Compounds 4, 13 and 23 were prepared as per the procedures illustrated in Examples 2, 4, and 5. Compound 35 is prepared using similar procedures published in Rouchaud et al., *Eur. J. Org. Chem.*, 2011, 12, 2346-2353.
Example 12
Preparation of Compound 40
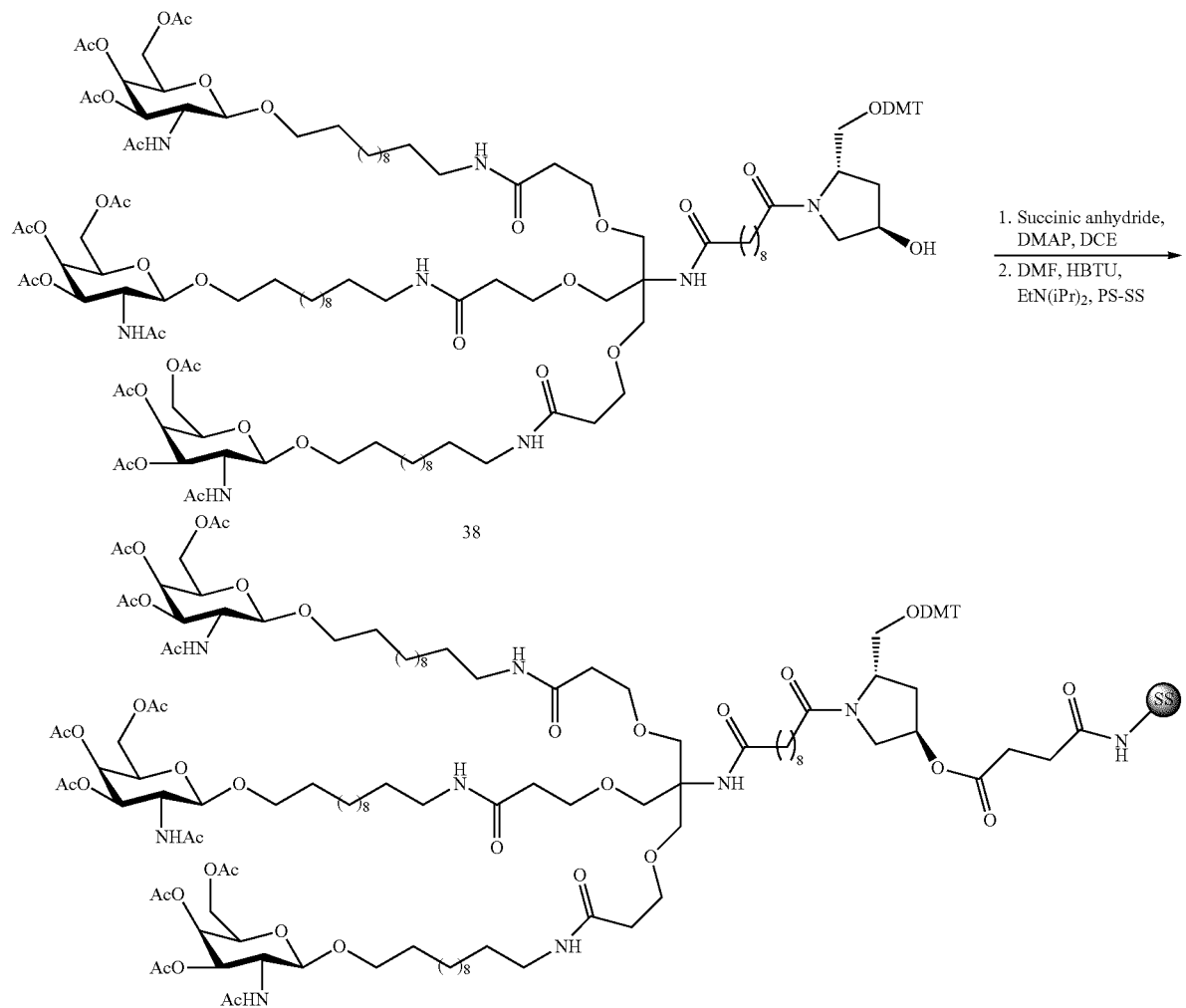

Compound 38 is prepared as per the procedures illustrated in Example 11.
Example 13
Preparation of Compound 44
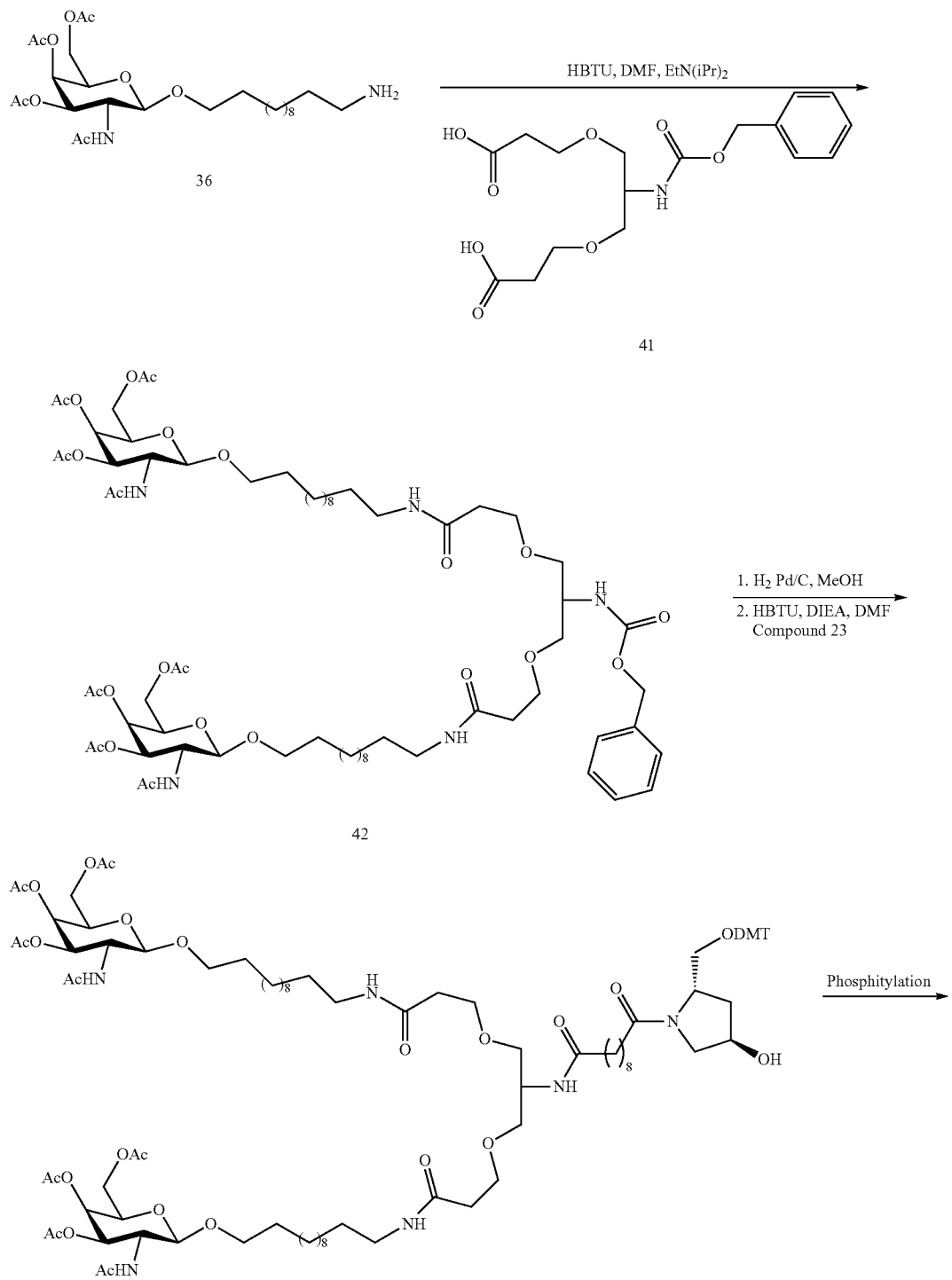

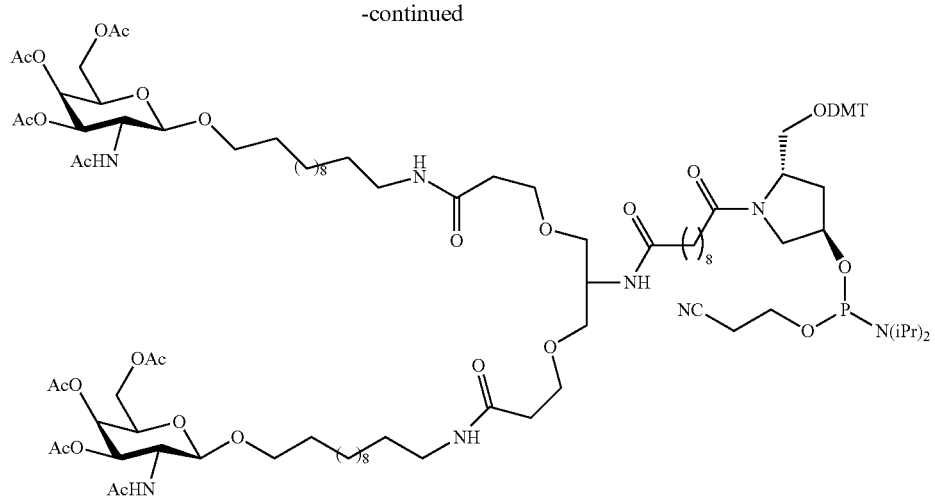
44
Compounds 23 and 36 are prepared as per the procedures illustrated in Examples 5 and 11. Compound 41 is prepared using similar procedures published in WO 2009082607.
Example 14
Preparation of Compound 45
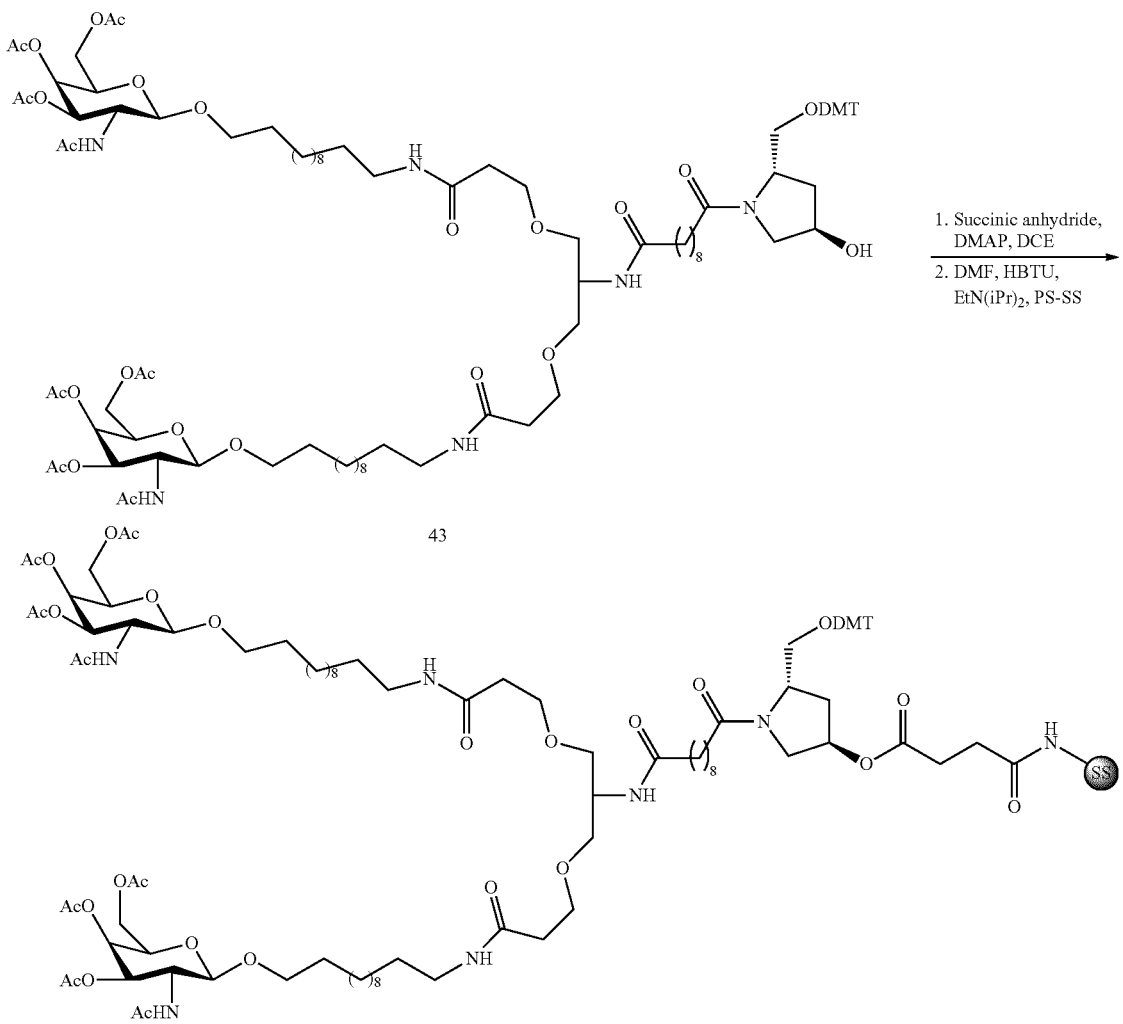

Compound 43 is prepared as per the procedures illustrated in Example 13.
Example 15
Preparation of Compound 47
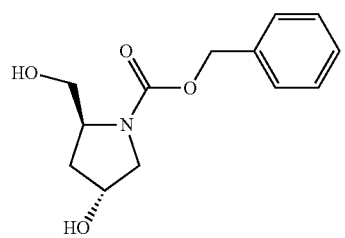
46
1. DMTCl, pyr
2. Pd/C, H₂, MeOH
Compound 46 is commercially available.
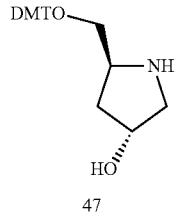
47
Example 16
Preparation of Compound 53
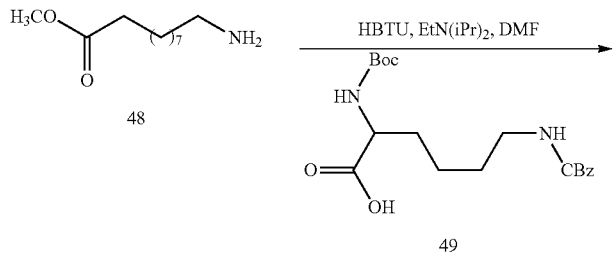
48     49
HBTU, EtN(iPr)₂, DMF
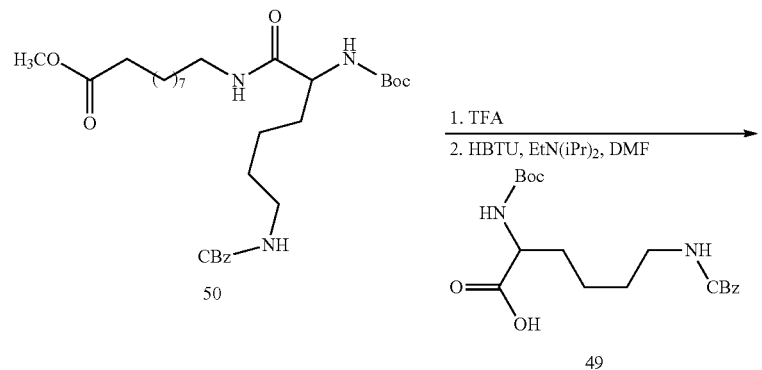
50     49
1. TFA
2. HBTU, EtN(iPr)₂, DMF
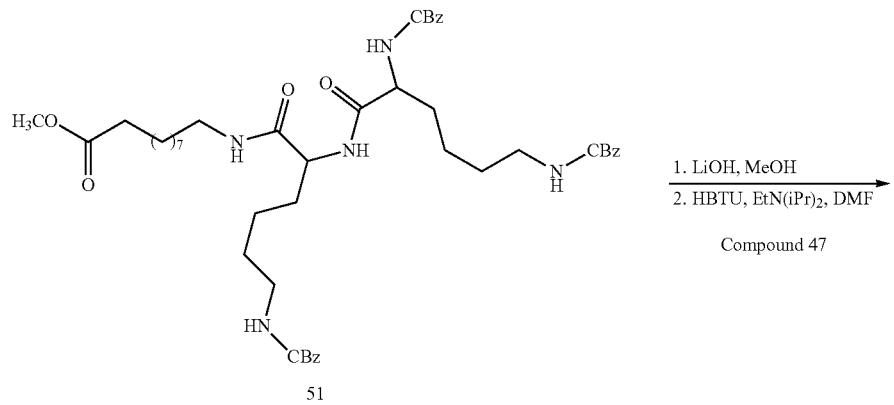
51
1. LiOH, MeOH
2. HBTU, EtN(iPr)₂, DMF
Compound 47

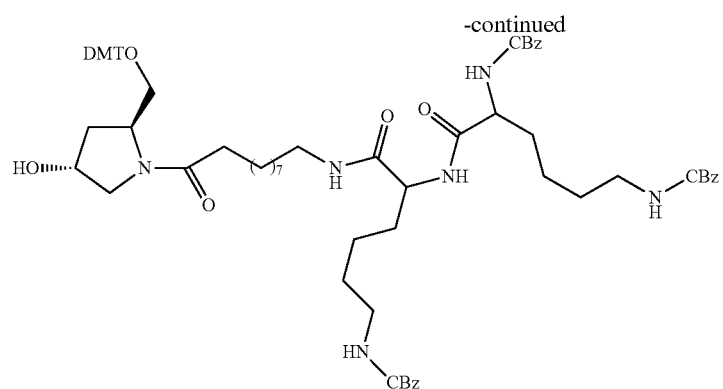
52
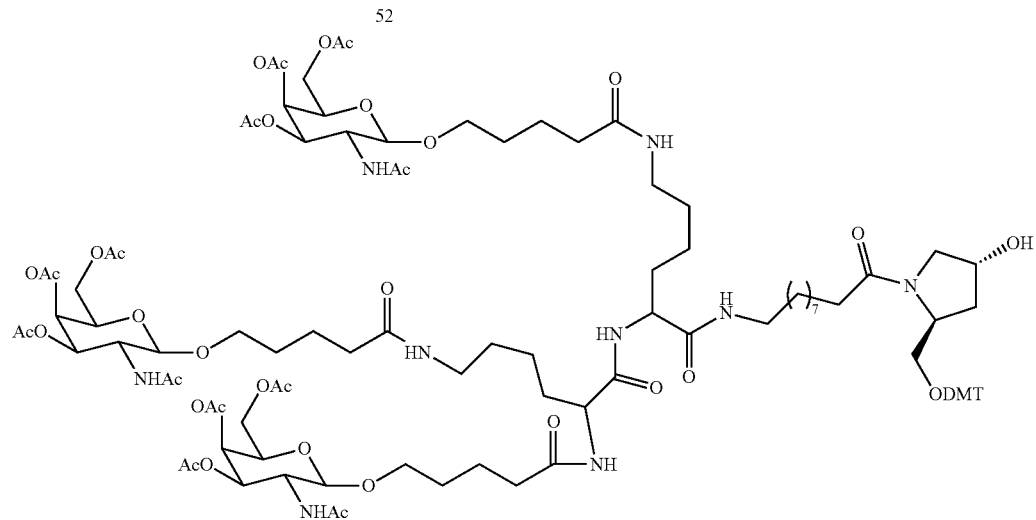
53
Compounds 48 and 49 are commercially available. Compounds 17 and 47 are prepared as per the procedures illustrated in Examples 4 and 15.
Example 17
Preparation of Compound 54
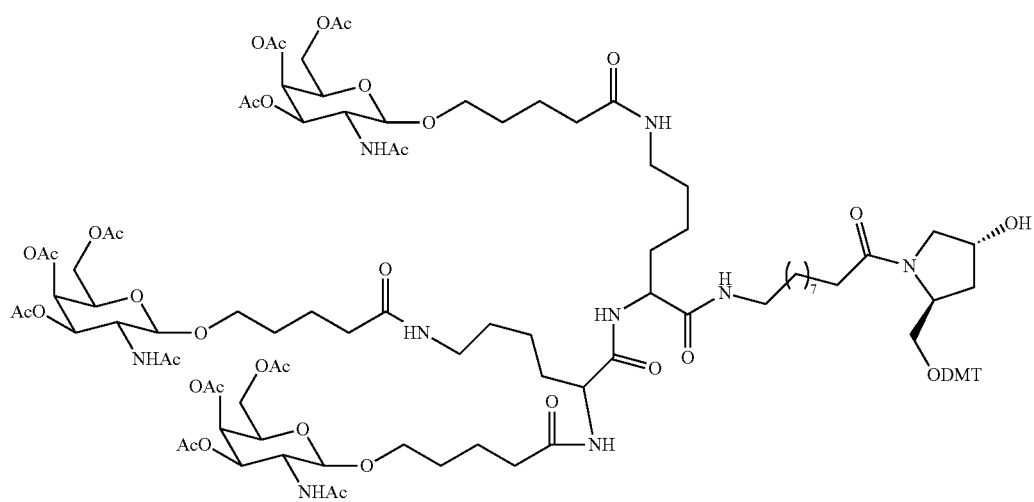
53
↓ Phosphitylation

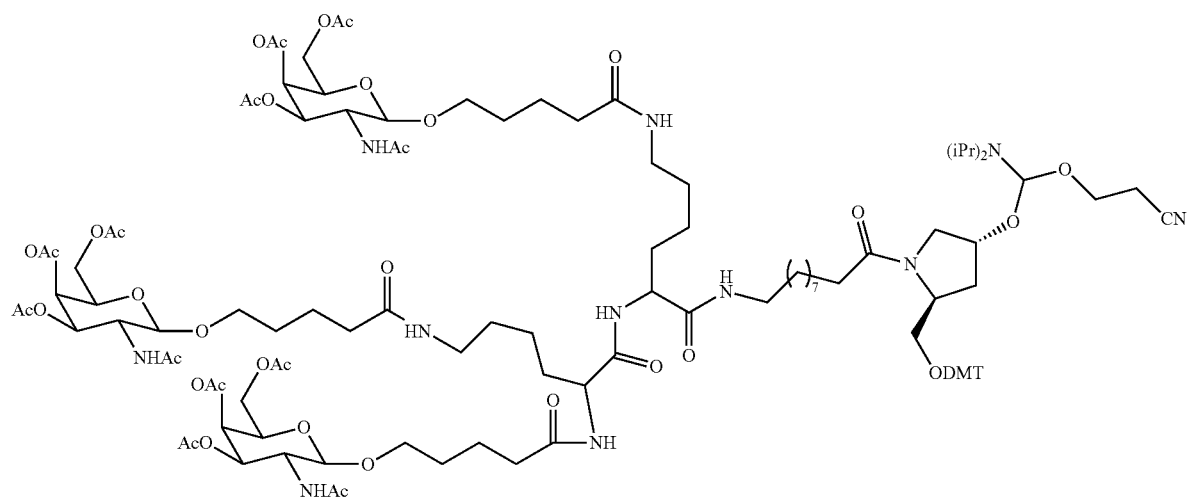
54
Compound 53 is prepared as per the procedures illustrated in Example 16.
Example 18
Preparation of Compound 55
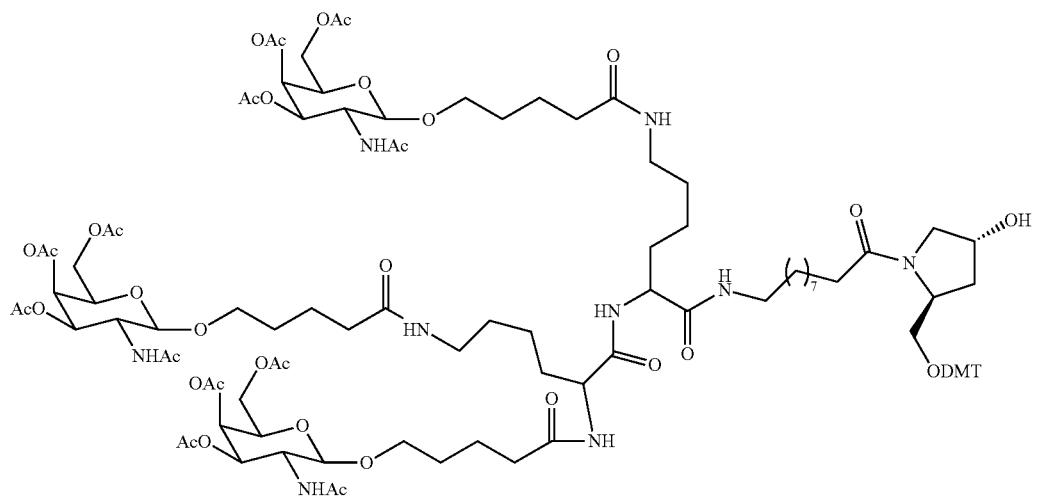
53
1. Succinic anhydride, DMAP, DCE
2. DMF, HBTU, EtN(iPr)₂, PS-SS

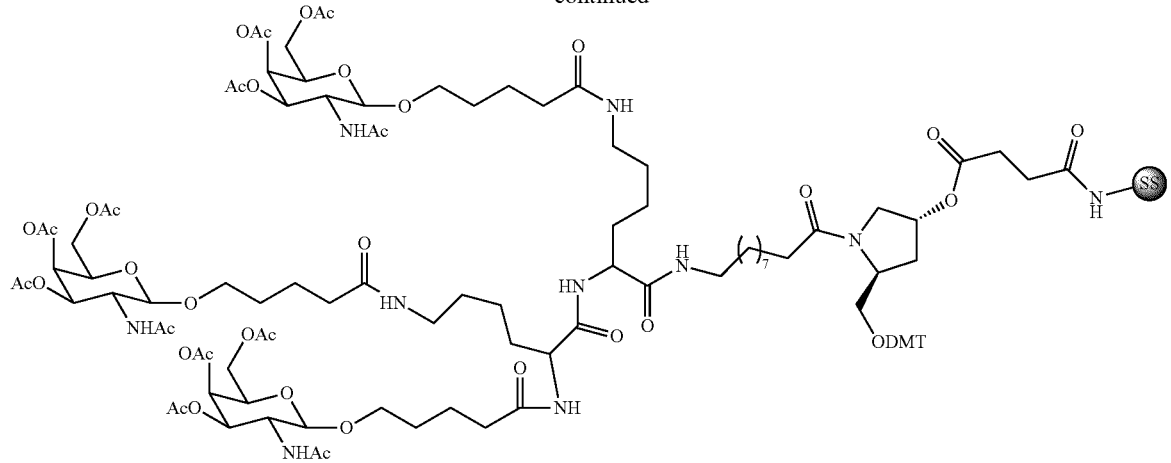

55

Compound 53 is prepared as per the procedures illustrated in Example 16.

Example 19

General Method for the Preparation of Conjugated ASOs Comprising GalNAc$_3$-1 at the 3' Position Via Solid Phase Techniques (Preparation of ISIS 647535, 647536 and 651900)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^m$C residues. A 0.1 M solution of phosphoramidite in anhydrous acetonitrile was used for β-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on an GalNAc$_3$-1 loaded VIMAD solid support (110 μmol/g, Guzaev et al., 2003) packed in the column. For the coupling step, the phosphoramidites were delivered 4 fold excess over the loading on the solid support and phosphoramidite condensation was carried out for 10 min. All other steps followed standard protocols supplied by the manufacturer. A solution of 6% dichloroacetic acid in toluene was used for removing dimethoxytrityl (DMT) group from 5'-hydroxyl group of the nucleotide. 4,5-Dicyanoimidazole (0.7 M) in anhydrous CH$_3$CN was used as activator during coupling step. Phosphorothioate linkages were introduced by sulfurization with 0.1 M solution of xanthane hydride in 1:1 pyridine/CH$_3$CN for a contact time of 3 minutes. A solution of 20% tert-butylhydroperoxide in CH$_3$CN containing 6% water was used as an oxidizing agent to provide phosphodiester internucleoside linkages with a contact time of 12 minutes.

After the desired sequence was assembled, the cyanoethyl phosphate protecting groups were deprotected using a 1:1 (v/v) mixture of triethylamine and acetonitrile with a contact time of 45 minutes. The solid-support bound ASOs were suspended in aqueous ammonia (28-30 wt %) and heated at 55° C. for 6 h.

The unbound ASOs were then filtered and the ammonia was boiled off. The residue was purified by high pressure liquid chromatography on a strong anion exchange column (GE Healthcare Bioscience, Source 30Q, 30 μm, 2.54×8 cm, A=100 mM ammonium acetate in 30% aqueous CH$_3$CN, B=1.5 M NaBr in A, 0-40% of B in 60 min, flow 14 mL min-1, λ=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

Antisense oligonucleotides not comprising a conjugate were synthesized using standard oligonucleotide synthesis procedures well known in the art.

Using these methods, three separate antisense compounds targeting ApoC III were prepared. As summarized in Table 17, below, each of the three antisense compounds targeting ApoC III had the same nucleobase sequence; ISIS 304801 is a 5-10-5 MOE gapmer having all phosphorothioate linkages; ISIS 647535 is the same as ISIS 304801, except that it had a GalNAc$_3$-1 conjugated at its 3' end; and ISIS 647536 is the same as ISIS 647535 except that certain internucleoside linkages of that compound are phosphodiester linkages. As further summarized in Table 17, two separate antisense compounds targeting SRB-1 were synthesized. ISIS 440762 was a 2-10-2 cEt gapmer with all phosphorothioate internucleoside linkages; ISIS 651900 is the same as ISIS 440762, except that it included a GalNAc$_3$-1 at its 3'-end.

TABLE 17

Modified ASO targeting ApoC III and SRB-1

| ASO | Sequence (5' to 3') | Target | CalCd Mass | Observed Mass | SEQ ID No. |
|---|---|---|---|---|---|
| ISIS 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | ApoC III | 7165.4 | 7164.4 | 32 |
| ISIS 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do'}$-GalNAc$_3$-1$_a$ | ApoC III | 9239.5 | 9237.8 | 111 |
| ISIS | A$_{es}$G$_{eo}$$^m$C$_{eo}$T$_{eo}$T$_{eo}$$^m$C$_{ds}$T$_{ds}$T$_{ds}$ | ApoC | 9142.9 | 9140.8 | 111 |

TABLE 17-continued

Modified ASO targeting ApoC III and SRB-1

| ASO | Sequence (5' to 3') | Target | CalCd Mass | Ob-served Mass | SEQ ID No. |
|---|---|---|---|---|---|
| 647536 | $G_{ds}T_{ds}{}^mC_{ds}{}^mC_{ds}A_{ds}G_{ds}{}^mC_{ds}$ $T_{es}T_{es}T_{es}A_{es}T_{eo}A_{do'}$-GalNAc$_3$-1$_a$ | III | | | |
| ISIS 440762 | $T_{ks}{}^mC_{ks}A_{ds}G_{ds}T_{ds}{}^mC_{ds}A_{ds}T_{ds}$ $G_{ds}A_{ds}{}^mC_{ds}T_{ds}T_{ks}{}^mC_k$ | SRB-1 | 4647.0 | 4646.4 | 104 |
| ISIS 651900 | $T_{ks}{}^mC_{ks}A_{ds}G_{ds}T_{ds}{}^mC_{ds}A_{ds}T_{ds}$ $G_{ds}A_{ds}{}^mC_{ds}T_{ds}T_{ks}{}^mC_kA_{do'}$-GalNAc$_3$-1$_a$ | SRB-1 | 6721.1 | 6719.4 | 112 |

Subscripts: "e" indicates 2'-MOE modified nucleoside; "d" indicates β-D-2'-deoxyribonucleoside; "k" indicates 6'-(S)—CH$_3$ bicyclic nucleoside (e.g. cEt); "s" indicates phosphorothioate internucleoside linkages (PS); "o" indicates phosphodiester internucleoside linkages (PO); and "o" indicates —O—P(=O)(OH)—. Superscript "m" indicates 5-methyl-cytosines. "GalNAc$_3$-1" indicates a conjugate group having the structure shown previously in Example 9. Note that Gal-NAc$_3$-1 comprises a cleavable adenosine which links the ASO to remainder of the conjugate, which is designated "GalNAc$_3$-1$_a$." This nomenclature is used in the above table to show the full nucleobase sequence, including the adenosine, which is part of the conjugate. Thus, in the above table, the sequences could also be listed as ending with "GalNAc$_3$-1" with the "A$_{do}$" omitted. This convention of using the subscript "a" to indicate the portion of a conjugate group lacking a cleavable nucleoside or cleavable moiety is used throughout these Examples. This portion of a conjugate group lacking the cleavable moiety is referred to herein as a "cluster" or "conjugate cluster" or "GalNAc$_3$ cluster." In certain instances it is convenient to describe a conjugate group by separately providing its cluster and its cleavable moiety.

Example 20

Dose-Dependent Antisense Inhibition of Human ApoC III in huApoC III Transgenic Mice ISIS 304801 and ISIS 647535, each targeting human ApoC III and described above, were separately tested and evaluated in a dose-dependent study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once a week for two weeks with ISIS 304801 or 647535 at 0.08, 0.25. 0.75, 2.25 or 6.75 µmol/kg or with PBS as a control. Each treatment group consisted of 4 animals. Forty-eight hours after the administration of the last dose, blood was drawn from each mouse and the mice were sacrificed and tissues were collected.

ApoC III mRNA Analysis

ApoC III mRNA levels in the mice's livers were determined using real-time PCR and RIBOGREEN® RNA quantification reagent (Molecular Probes, Inc. Eugene, Oreg.) according to standard protocols. ApoC III mRNA levels were determined relative to total RNA (using Ribogreen), prior to normalization to PBS-treated control. The results below are presented as the average percent of ApoC III mRNA levels for each treatment group, normalized to PBS-treated control and are denoted as "% PBS". The half maximal effective dosage (ED$_{50}$) of each ASO is also presented in Table 18, below.

As illustrated, both antisense compounds reduced ApoC III RNA relative to the PBS control. Further, the antisense compound conjugated to GalNAc$_3$-1 (ISIS 647535) was substantially more potent than the antisense compound lacking the GalNAc$_3$-1 conjugate (ISIS 304801).

TABLE 18

Effect of ASO treatment on ApoC III mRNA levels in human ApoC III transgenic mice

| ASO | Dose (µmol/kg) | % PBS | ED$_{50}$ (µmol/kg) | 3' Conjugate | Internucleoside linkage/Length | SEQ ID No. |
|---|---|---|---|---|---|---|
| PBS | 0 | 100 | — | — | — | |
| ISIS 304801 | 0.08 | 95 | 0.77 | None | PS/20 | 32 |
| | 0.75 | 42 | | | | |
| | 2.25 | 32 | | | | |
| | 6.75 | 19 | | | | |
| ISIS 647535 | 0.08 | 50 | 0.074 | GalNAc$_3$-1 | PS/20 | 111 |
| | 0.75 | 15 | | | | |
| | 2.25 | 17 | | | | |
| | 6.75 | 8 | | | | |

ApoC III Protein Analysis (Turbidometric Assay)

Plasma ApoC III protein analysis was determined using procedures reported by Graham et al, *Circulation Research*, published online before print Mar. 29, 2013.

Approximately 100 µl of plasma isolated from mice was analyzed without dilution using an Olympus Clinical Analyzer and a commercially available turbidometric ApoC III assay (Kamiya, Cat# KAI-006, Kamiya Biomedical, Seattle, Wash.). The assay protocol was performed as described by the vendor.

As shown in the Table 19 below, both antisense compounds reduced ApoC III protein relative to the PBS control. Further, the antisense compound conjugated to GalNAc$_3$-1 (ISIS 647535) was substantially more potent than the antisense compound lacking the GalNAc$_3$-1 conjugate (ISIS 304801).

TABLE 19

Effect of ASO treatment on ApoC III plasma protein levels in human ApoC III transgenic mice

| ASO | Dose (µmol/kg) | % PBS | ED$_{50}$ (µmol/kg) | 3' Conjugate | Internucleoside Linkage/Length | SEQ ID No. |
|---|---|---|---|---|---|---|
| PBS | 0 | 100 | — | — | — | |
| ISIS 304801 | 0.08 | 86 | 0.73 | None | PS/20 | 32 |
| | 0.75 | 51 | | | | |
| | 2.25 | 23 | | | | |
| | 6.75 | 13 | | | | |
| ISIS 647535 | 0.08 | 72 | 0.19 | GalNAc$_3$-1 | PS/20 | 111 |
| | 0.75 | 14 | | | | |
| | 2.25 | 12 | | | | |
| | 6.75 | 11 | | | | |

Plasma triglycerides and cholesterol were extracted by the method of Bligh and Dyer (Bligh, E. G. and Dyer, W. J. *Can. J. Biochem. Physiol.* 37: 911-917, 1959)(Bligh, E and Dyer, W, *Can J Biochem Physiol*, 37, 911-917, 1959)(Bligh, E and Dyer, W, *Can J Biochem Physiol*, 37, 911-917, 1959) and measured by using a Beckmann Coulter clinical analyzer and commercially available reagents.

The triglyceride levels were measured relative to PBS injected mice and are denoted as "% PBS". Results are presented in Table 20. As illustrated, both antisense compounds lowered triglyceride levels. Further, the antisense compound conjugated to GalNAc$_3$-1 (ISIS 647535) was substantially more potent than the antisense compound lacking the GalNAc$_3$-1 conjugate (ISIS 304801).

TABLE 20

Effect of ASO treatment on triglyceride levels in transgenic mice

| ASO | Dose (μmol/kg) | % PBS | ED$_{50}$ (μmol/kg) | 3' Conjugate | Internucleoside Linkage/ Length | SEQ ID No. |
|---|---|---|---|---|---|---|
| PBS | 0 | 100 | — | — | — | |
| ISIS 304801 | 0.08 | 87 | 0.63 | None | PS/20 | 32 |
| | 0.75 | 46 | | | | |
| | 2.25 | 21 | | | | |
| | 6.75 | 12 | | | | |
| ISIS 647535 | 0.08 | 65 | 0.13 | GalNAc$_3$-1 | PS/20 | 111 |
| | 0.75 | 9 | | | | |
| | 2.25 | 8 | | | | |
| | 6.75 | 9 | | | | |

Plasma samples were analyzed by HPLC to determine the amount of total cholesterol and of different fractions of cholesterol (HDL and LDL). Results are presented in Tables 21 and 22. As illustrated, both antisense compounds lowered total cholesterol levels; both lowered LDL; and both raised HDL. Further, the antisense compound conjugated to GalNAc$_3$-1 (ISIS 647535) was substantially more potent than the antisense compound lacking the GalNAc$_3$-1 conjugate (ISIS 304801). An increase in HDL and a decrease in LDL levels is a cardiovascular beneficial effect of antisense inhibition of ApoC III.

TABLE 21

Effect of ASO treatment on total cholesterol levels in transgenic mice

| ASO | Dose (μmol/kg) | Total Cholesterol (mg/dL) | 3' Conjugate | Internucleoside Linkage/ Length | SEQ ID No. |
|---|---|---|---|---|---|
| PBS | 0 | 257 | — | — | |
| ISIS 304801 | 0.08 | 226 | None | PS/20 | 32 |
| | 0.75 | 164 | | | |
| | 2.25 | 110 | | | |
| | 6.75 | 82 | | | |
| ISIS 647535 | 0.08 | 230 | GalNAc$_3$-1 | PS/20 | 111 |
| | 0.75 | 82 | | | |
| | 2.25 | 86 | | | |
| | 6.75 | 99 | | | |

TABLE 22

Effect of ASO treatment on HDL and LDL cholesterol levels in transgenic mice

| ASO | Dose (μmol/kg) | HDL (mg/dL) | LDL (mg/dL) | 3' Conjugate | Internucleoside Linkage/ Length | SEQ ID No. |
|---|---|---|---|---|---|---|
| PBS | 0 | 17 | 28 | — | — | |
| ISIS | 0.08 | 17 | 23 | None | PS/20 | 32 |

TABLE 22-continued

Effect of ASO treatment on HDL and LDL cholesterol levels in transgenic mice

| ASO | Dose (μmol/kg) | HDL (mg/dL) | LDL (mg/dL) | 3' Conjugate | Internucleoside Linkage/ Length | SEQ ID No. |
|---|---|---|---|---|---|---|
| 304801 | 0.75 | 27 | 12 | | | |
| | 2.25 | 50 | 4 | | | |
| | 6.75 | 45 | 2 | | | |
| ISIS 647535 | 0.08 | 21 | 21 | GalNAc$_3$-1 | PS/20 | 111 |
| | 0.75 | 44 | 2 | | | |
| | 2.25 | 50 | 2 | | | |
| | 6.75 | 58 | 2 | | | |

Pharmacokinetics Analysis (PK)

The PK of the ASOs was also evaluated. Liver and kidney samples were minced and extracted using standard protocols. Samples were analyzed on MSD1 utilizing IP-HPLC-MS. The tissue level (μg/g) of full-length ISIS 304801 and 647535 was measured and the results are provided in Table 23. As illustrated, liver concentrations of total full-length antisense compounds were similar for the two antisense compounds. Thus, even though the GalNAc$_3$-1-conjugated antisense compound is more active in the liver (as demonstrated by the RNA and protein data above), it is not present at substantially higher concentration in the liver. Indeed, the calculated EC$_{50}$ (provided in Table 23) confirms that the observed increase in potency of the conjugated compound cannot be entirely attributed to increased accumulation. This result suggests that the conjugate improved potency by a mechanism other than liver accumulation alone, possibly by improving the productive uptake of the antisense compound into cells.

The results also show that the concentration of GalNAc$_3$-1 conjugated antisense compound in the kidney is lower than that of antisense compound lacking the GalNAc conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly, for non-kidney targets, kidney accumulation is undesired. These data suggest that GalNAc$_3$-1 conjugation reduces kidney accumulation.

TABLE 23

PK analysis of ASO treatment in transgenic mice

| ASO | Dose (μmol/kg) | Liver (μg/g) | Kidney (μg/g) | Liver EC$_{50}$ (μg/g) | 3' Conjugate | Internucleoside Linkage/ Length | SEQ ID No. |
|---|---|---|---|---|---|---|---|
| ISIS 304801 | 0.1 | 5.2 | 2.1 | 53 | None | PS/20 | 32 |
| | 0.8 | 62.8 | 119.6 | | | | |
| | 2.3 | 142.3 | 191.5 | | | | |
| | 6.8 | 202.3 | 337.7 | | | | |
| ISIS 647535 | 0.1 | 3.8 | 0.7 | 3.8 | GalNAc$_3$-1 | PS/20 | 111 |
| | 0.8 | 72.7 | 34.3 | | | | |
| | 2.3 | 106.8 | 111.4 | | | | |
| | 6.8 | 237.2 | 179.3 | | | | |

Metabolites of ISIS 647535 were also identified and their masses were confirmed by high resolution mass spectrometry analysis. The cleavage sites and structures of the observed metabolites are shown below. The relative % of full length ASO was calculated using standard procedures and the results are presented in Table 23a. The major metabolite of ISIS 647535 was full-length ASO lacking the entire conjugate (i.e. ISIS 304801), which results from cleavage at cleavage site A, shown below. Further, additional metabolites resulting from other cleavage sites were also observed. These results suggest that introducing other cleabable bonds such as esters, peptides, disulfides, phosphoramidates or acyl-hydrazones between the GalNAc$_3$-1 sugar and the ASO, which can be cleaved by enzymes inside the cell, or which may cleave in the reductive environment of the cytosol, or which are labile to the acidic pH inside endosomes and lyzosomes, can also be useful.

TABLE 23a

Observed full length metabolites of ISIS 647535

| Metabolite | ASO | Cleavage site | Relative % |
|---|---|---|---|
| 1 | ISIS 304801 | A | 36.1 |
| 2 | ISIS 304801 + dA | B | 10.5 |
| 3 | ISIS 647535 minus [3 GalNAc] | C | 16.1 |
| 4 | ISIS 647535 minus [3 GalNAc + 1 5-hydroxy-pentanoic acid tether] | D | 17.6 |
| 5 | ISIS 647535 minus [2 GalNAc + 2 5-hydroxy-pentanoic acid tether] | D | 9.9 |
| 6 | ISIS 647535 minus [3 GalNAc + 3 5-hydroxy-pentanoic acid tether] | D | 9.8 |

Cleavage Sites

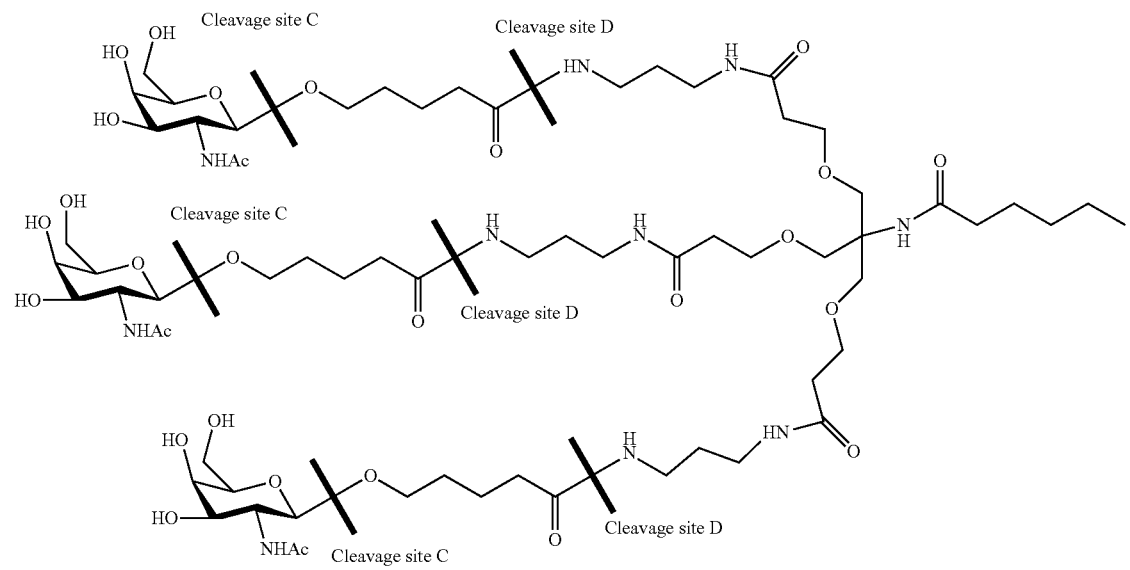

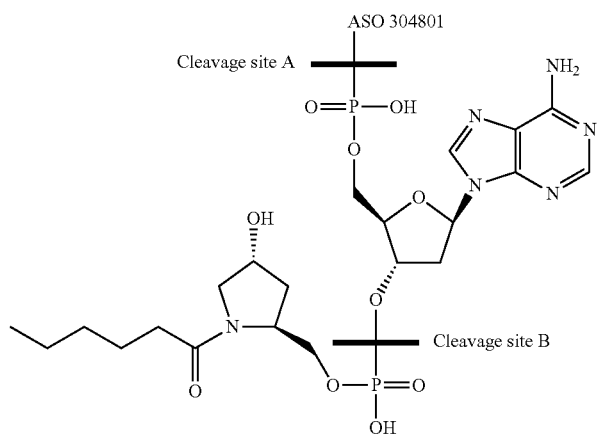

715                                                                    716
                              -continued
Metabolite 1                                                      Metabolite 2
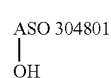
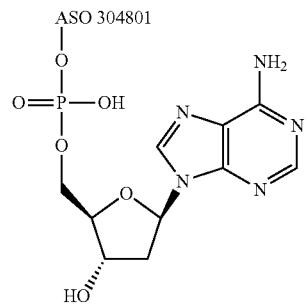
Metabolite 3
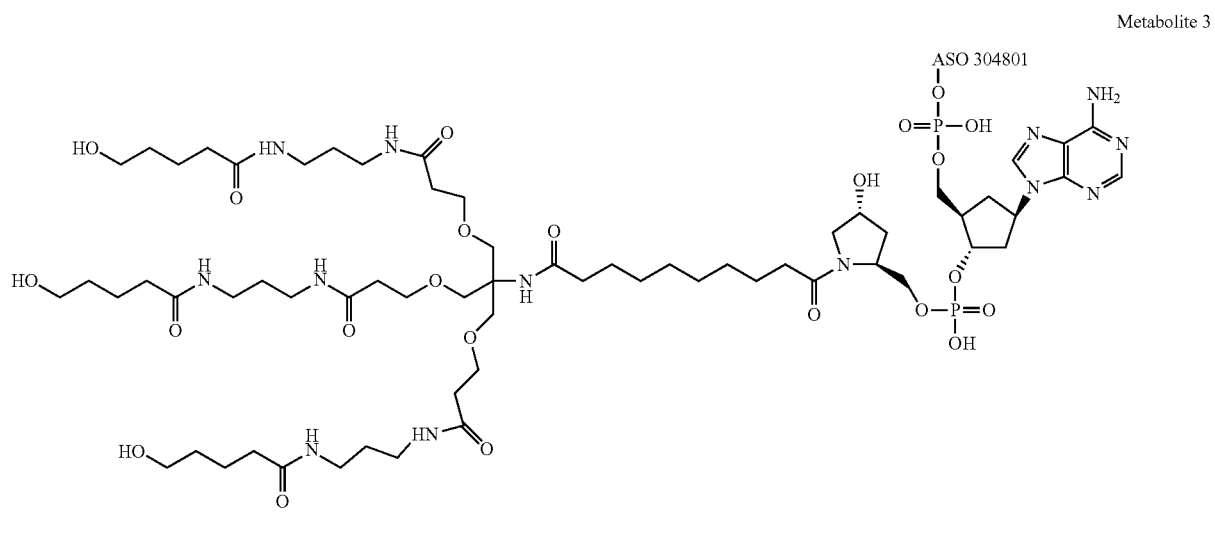
Metabolite 4
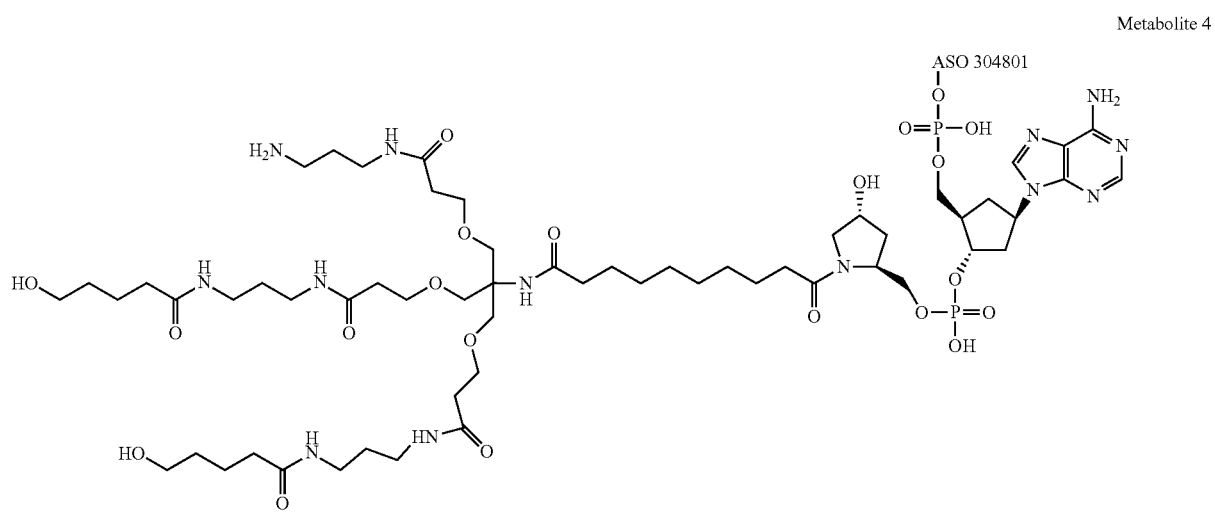

Metabolite 5

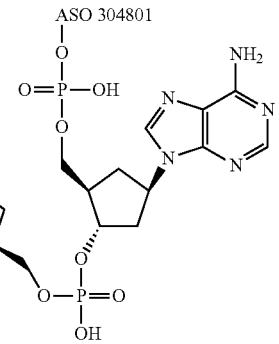
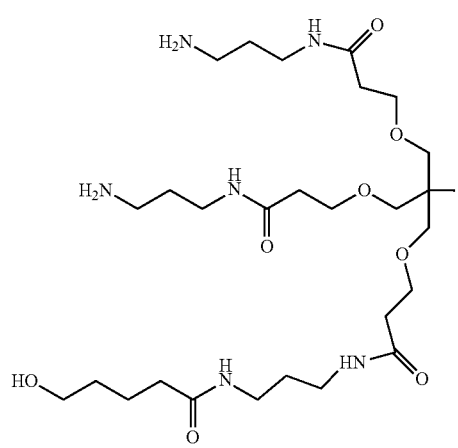

Metabolite 6

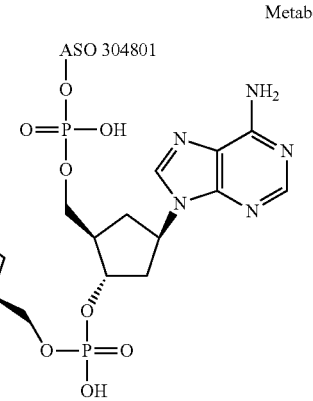
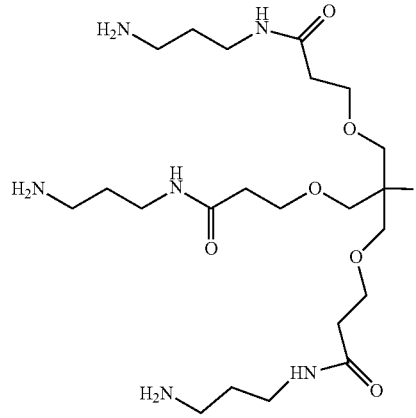

Example 21

Antisense Inhibition of Human ApoC III in Human ApoC III Transgenic Mice in Single Administration Study ISIS 304801, 647535 and 647536 each targeting human ApoC III and described in Table 17, were further evaluated in a single administration study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once at the dosage shown below with ISIS 304801, 647535 or 647536 (described above) or with PBS treated control. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III mRNA and protein levels in the liver; plasma triglycerides; and cholesterol, including HDL and LDL fractions were assessed as described above (Example 20). Data from those analyses are presented in Tables 24-28, below. Liver transaminase levels, alanine aminotransferase (ALT) and aspartate aminotransferase (AST), in serum were measured relative to saline injected mice using standard protocols. The ALT and AST levels showed that the antisense compounds were well tolerated at all administered doses.

These results show improvement in potency for antisense compounds comprising a GalNAc$_3$-1 conjugate at the 3' terminus (ISIS 647535 and 647536) compared to the antisense compound lacking a GalNAc$_3$-1 conjugate (ISIS 304801). Further, ISIS 647536, which comprises a GalNAc$_3$-1 conjugate and some phosphodiester linkages was as potent as ISIS 647535, which comprises the same conjugate and all internucleoside linkages within the ASO are phosphorothioate.

TABLE 24

Effect of ASO treatment on ApoC III mRNA levels in human ApoC III transgenic mice

| ASO | Dose (mg/kg) | % PBS | ED$_{50}$ (mg/kg) | 3' Conjugate | Internucleoside linkage/Length | SEQ ID No. |
|---|---|---|---|---|---|---|
| PBS | 0 | 99 | — | — | — | |
| ISIS 304801 | 1 | 104 | 13.2 | None | PS/20 | 32 |
| | 3 | 92 | | | | |
| | 10 | 71 | | | | |
| | 30 | 40 | | | | |
| ISIS 647535 | 0.3 | 98 | 1.9 | GalNAc$_3$-1 | PS/20 | 111 |
| | 1 | 70 | | | | |
| | 3 | 33 | | | | |
| | 10 | 20 | | | | |
| ISIS 647536 | 0.3 | 103 | 1.7 | GalNAc$_3$-1 | PS/PO/20 | 111 |
| | 1 | 60 | | | | |
| | 3 | 31 | | | | |
| | 10 | 21 | | | | |

TABLE 25

Effect of ASO treatment on ApoC III plasma protein levels in human ApoC III transgenic mice

| ASO | Dose (mg/kg) | % PBS | ED$_{50}$ (mg/kg) | 3' Conjugate | Internucleoside Linkage/Length | SEQ ID No. |
|---|---|---|---|---|---|---|
| PBS | 0 | 99 | — | — | — | |
| ISIS 304801 | 1 | 104 | 23.2 | None | PS/20 | 32 |
| | 3 | 92 | | | | |
| | 10 | 71 | | | | |
| | 30 | 40 | | | | |
| ISIS 647535 | 0.3 | 98 | 2.1 | GalNAc$_3$-1 | PS/20 | 111 |
| | 1 | 70 | | | | |
| | 3 | 33 | | | | |
| | 10 | 20 | | | | |
| ISIS 647536 | 0.3 | 103 | 1.8 | GalNAc$_3$-1 | PS/PO/20 | 111 |
| | 1 | 60 | | | | |
| | 3 | 31 | | | | |
| | 10 | 21 | | | | |

TABLE 26

Effect of ASO treatment on triglyceride levels in transgenic mice

| ASO | Dose (mg/kg) | % PBS | ED$_{50}$ (mg/kg) | 3' Conjugate | Internucleoside Linkage/Length | SEQ ID No. |
|---|---|---|---|---|---|---|
| PBS | 0 | 98 | — | — | — | |
| ISIS 304801 | 1 | 80 | 29.1 | None | PS/20 | 32 |
| | 3 | 92 | | | | |
| | 10 | 70 | | | | |
| | 30 | 47 | | | | |
| ISIS 647535 | 0.3 | 100 | 2.2 | GalNAc$_3$-1 | PS/20 | 111 |
| | 1 | 70 | | | | |
| | 3 | 34 | | | | |
| | 10 | 23 | | | | |
| ISIS 647536 | 0.3 | 95 | 1.9 | GalNAc$_3$-1 | PS/PO/20 | 111 |
| | 1 | 66 | | | | |
| | 3 | 31 | | | | |
| | 10 | 23 | | | | |

TABLE 27

Effect of ASO treatment on total cholesterol levels in transgenic mice

| ASO | Dose (mg/kg) | % PBS | 3' Conjugate | Internucleoside Linkage/Length | SEQ ID No. |
|---|---|---|---|---|---|
| PBS | 0 | 96 | — | — | |
| ISIS 304801 | 1 | 104 | None | PS/20 | 32 |
| | 3 | 96 | | | |
| | 10 | 86 | | | |
| | 30 | 72 | | | |
| ISIS 647535 | 0.3 | 93 | GalNAc$_3$-1 | PS/20 | 111 |
| | 1 | 85 | | | |
| | 3 | 61 | | | |
| | 10 | 53 | | | |
| ISIS 647536 | 0.3 | 115 | GalNAc$_3$-1 | PS/PO/20 | 111 |
| | 1 | 79 | | | |
| | 3 | 51 | | | |
| | 10 | 54 | | | |

TABLE 28

Effect of ASO treatment on HDL and LDL cholesterol levels in transgenic mice

| ASO | Dose (mg/kg) | HDL % PBS | LDL % PBS | 3' Conjugate | Internucleoside Linkage/Length | SEQ ID No. |
|---|---|---|---|---|---|---|
| PBS | 0 | 131 | 90 | — | — | |
| ISIS 304801 | 1 | 130 | 72 | None | PS/20 | 32 |
| | 3 | 186 | 79 | | | |
| | 10 | 226 | 63 | | | |
| | 30 | 240 | 46 | | | |
| ISIS 647535 | 0.3 | 98 | 86 | GalNAc$_3$-1 | PS/20 | 111 |
| | 1 | 214 | 67 | | | |
| | 3 | 212 | 39 | | | |
| | 10 | 218 | 35 | | | |
| ISIS 647536 | 0.3 | 143 | 89 | GalNAc$_3$-1 | PS/PO/20 | 111 |
| | 1 | 187 | 56 | | | |
| | 3 | 213 | 33 | | | |
| | 10 | 221 | 34 | | | |

These results confirm that the GalNAc$_3$-1 conjugate improves potency of an antisense compound. The results also show equal potency of a GalNAc$_3$-1 conjugated antisense compounds where the antisense oligonucleotides have mixed linkages (ISIS 647536 which has six phosphodiester linkages) and a full phosphorothioate version of the same antisense compound (ISIS 647535).

Phosphorothioate linkages provide several properties to antisense compounds. For example, they resist nuclease digestion and they bind proteins resulting in accumulation of compound in the liver, rather than in the kidney/urine. These are desirable properties, particularly when treating an indication in the liver. However, phosphorothioate linkages have also been associated with an inflammatory response. Accordingly, reducing the number of phosphorothioate linkages in a compound is expected to reduce the risk of inflammation, but also lower concentration of the compound in liver, increase concentration in the kidney and urine, decrease stability in the presence of nucleases, and lower overall potency. The present results show that a GalNAc$_3$-1 conjugated antisense compound where certain phosphorothioate linkages have been replaced with phosphodiester linkages is as potent against a target in the liver as a counterpart having full phosphorothioate linkages. Such compounds are expected to be less proinflammatory (See Example 24 describing an experiment showing reduction of PS results in reduced inflammatory effect).

Example 22

Effect of GalNAc$_3$-1 Conjugated Modified ASO Targeting SRB-1 In Vivo

ISIS 440762 and 651900, each targeting SRB-1 and described in Table 17, were evaluated in a dose-dependent study for their ability to inhibit SRB-1 in Balb/c mice.

Treatment

Six week old male Balb/c mice (Jackson Laboratory, Bar Harbor, Me.) were injected subcutaneously once at the dosage shown below with ISIS 440762, 651900 or with PBS treated control. Each treatment group consisted of 4 animals. The mice were sacrificed 48 hours following the final administration to determine the SRB-1 mRNA levels in liver using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS".

As illustrated in Table 29, both antisense compounds lowered SRB-1 mRNA levels. Further, the antisense compound comprising the GalNAc$_3$-1 conjugate (ISIS 651900) was substantially more potent than the antisense compound lacking the GalNAc$_3$-1 conjugate (ISIS 440762). These results demonstrate that the potency benefit of GalNAc$_3$-1 conjugates are observed using antisense oligonucleotides complementary to a different target and having different chemically modified nucleosides, in this instance modified nucleosides comprise constrained ethyl sugar moieties (a bicyclic sugar moiety).

TABLE 29

Effect of ASO treatment on SRB-1 mRNA levels in Balb/c mice

| ASO | Dose (mg/kg) | Liver % PBS | ED$_{50}$ (mg/kg) | 3' Conjugate | Internucleoside linkage/Length | SEQ ID No. |
|---|---|---|---|---|---|---|
| PBS | 0 | 100 | — | — | — | |
| ISIS 440762 | 0.7 | 85 | 2.2 | None | PS/14 | 104 |
| | 2 | 55 | | | | |
| | 7 | 12 | | | | |
| | 20 | 3 | | | | |
| ISIS 651900 | 0.07 | 98 | 0.3 | GalNAc$_3$-1 | PS/14 | 112 |
| | 0.2 | 63 | | | | |
| | 0.7 | 20 | | | | |
| | 2 | 6 | | | | |
| | 7 | 5 | | | | |

Example 23

Human Peripheral Blood Mononuclear Cells (hPBMC) Assay Protocol

The hPBMC assay was performed using BD Vautainer CPT tube method. A sample of whole blood from volunteered donors with informed consent at US HealthWorks clinic (Faraday & El Camino Real, Carlsbad) was obtained and collected in 4-15 BD Vacutainer CPT 8 ml tubes (VWR Cat. # BD362753). The approximate starting total whole blood volume in the CPT tubes for each donor was recorded using the PBMC assay data sheet.

The blood sample was remixed immediately prior to centrifugation by gently inverting tubes 8-10 times. CPT tubes were centrifuged at rt (18-25° C.) in a horizontal (swing-out) rotor for 30 min at 1500-1800 RCF with brake off (2700 RPM Beckman Allegra 6R). The cells were retrieved from the buffy coat interface (between Ficoll and polymer gel layers); transferred to a sterile 50 ml conical tube and pooled up to 5 CPT tubes/50 ml conical tube/donor. The cells were then washed twice with PBS (Ca$^{++}$, Mg$^{++}$ free; GIBCO). The tubes were topped up to 50 ml and mixed by inverting several times. The sample was then centrifuged at 330×g for 15 minutes at rt (1215 RPM in Beckman Allegra 6R) and aspirated as much supernatant as possible without disturbing pellet. The cell pellet was dislodged by gently swirling tube and resuspended cells in RPMI+10% FBS+pen/strep (~1 ml/10 ml starting whole blood volume). A 60 µl sample was pipette into a sample vial (Beckman Coulter) with 600 µl VersaLyse reagent (Beckman Coulter Cat# A09777) and was gently vortexed for 10-15 sec. The sample was allowed to incubate for 10 min at rt and being mixed again before counting. The cell suspension was counted on Vicell XR cell viability analyzer (Beckman Coulter) using PBMC cell type (dilution factor of 1:11 was stored with other parameters). The live cell/ml and viability were recorded. The cell suspension was diluted to 1×10$^7$ live PBMC/ml in RPMI+10% FBS+pen/strep.

The cells were plated at 5×10$^5$ in 50 µl/well of 96-well tissue culture plate (Falcon Microtest). 50 µl/well of 2× concentration oligos/controls diluted in RPMI+10% FBS+pen/strep. was added according to experiment template (100 µl/well total). Plates were placed on the shaker and allowed to mix for approx. 1 min. After being incubated for 24 hrs at 37° C.; 5% CO$_2$, the plates were centrifuged at 400×g for 10 minutes before removing the supernatant for MSD cytokine assay (i.e. human IL-6, IL-10, IL-8 and MCP-1).

Example 24

Evaluation of Proinflammatory Effects in hPBMC Assay for GalNAc$_3$-1 Conjugated ASOs The antisense oligonucleotides (ASOs) listed in Table 30 were evaluated for proinflammatory effect in hPBMC assay using the protocol described in Example 23. ISIS 353512 is an internal standard known to be a high responder for IL-6 release in the assay. The hPBMCs were isolated from fresh, volunteered donors and were treated with ASOs at 0, 0.0128, 0.064, 0.32, 1.6, 8, 40 and 200 µM concentrations. After a 24 hr treatment, the cytokine levels were measured.

The levels of IL-6 were used as the primary readout. The EC$_{50}$ and E$_{max}$ was calculated using standard procedures. Results are expressed as the average ratio of E$_{max}$/EC$_{50}$ from two donors and is denoted as "E$_{max}$/EC$_{50}$." The lower ratio indicates a relative decrease in the proinflammatory response and the higher ratio indicates a relative increase in the proinflammatory response.

With regard to the test compounds, the least proinflammatory compound was the PS/PO linked ASO (ISIS 616468). The GalNAc$_3$-1 conjugated ASO, ISIS 647535 was slightly less proinflammatory than its non-conjugated counterpart ISIS 304801. These results indicate that incorporation of some PO linkages reduces proinflammatory reaction and addition of a GalNAc$_3$-1 conjugate does not make a compound more proinflammatory and may reduce proinflammatory response. Accordingly, one would expect that an antisense compound comprising both mixed PS/PO linkages and a GalNAc$_3$-1 conjugate would produce lower proinflammatory responses relative to full PS linked antisense compound with or without a GalNAc$_3$-1 conjugate. These results show that GalNAc$_3$-1 conjugated antisense compounds, particularly those having reduced PS content are less proinflammatory.

Together, these results suggest that a GalNAc$_3$-1 conjugated compound, particularly one with reduced PS content, can be administered at a higher dose than a counterpart full PS antisense compound lacking a GalNAc$_3$-1 conjugate. Since half-life is not expected to be substantially different for these compounds, such higher administration would result in less frequent dosing. Indeed such administration could be even less frequent, because the GalNAc$_3$-1 conjugated compounds are more potent (See Examples 20-22) and re-dosing is necessary once the concentration of a compound has dropped below a desired level, where such desired level is based on potency.

TABLE 30

Modified ASOs

| ASO | Sequence (5' to 3') | Target | SEQ ID No. |
|---|---|---|---|
| ISIS 104838 | G$_{es}$$^m$C$_{es}$T$_{es}$G$_{es}$A$_{es}$T$_{ds}$T$_{ds}$A$_{ds}$G$_{ds}$A$_{ds}$G$_{ds}$A$_{ds}$G$_{ds}$A$_{ds}$G$_{ds}$G$_{es}$T$_{es}$$^m$C$_{es}$$^m$C$_{es}$$^m$C$_e$ | TNFα | 105 |
| ISIS 353512 | T$_{es}$$^m$C$_{es}$$^m$C$_{es}$$^m$C$_{ds}$A$_{ds}$T$_{ds}$T$_{ds}$T$_{ds}$$^m$C$_{ds}$A$_{ds}$G$_{ds}$G$_{ds}$A$_{ds}$G$_{ds}$A$_{ds}$$^m$C$_{ds}$$^m$C$_{ds}$T$_{es}$G$_{es}$G$_e$ | CRP | 106 |
| ISIS 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | ApoC III | 32 |
| ISIS 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do'}$-GalNAc$_3$-1$_a$ | ApoC III | 111 |
| ISIS 616468 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{eo}$T$_{eo}$T$_{es}$A$_{es}$T$_e$ | ApoC III | 32 |

Subscripts: "e" indicates 2'-MOE modified nucleoside; "d" indicates (3-D-2'-deoxyribonucleoside; "k" indicates 6'-(S)—CH$_3$ bicyclic nucleoside (e.g. cEt); "s" indicates phosphorothioate internucleoside linkages (PS); "o" indicates phosphodiester internucleoside linkages (PO); and "o" indicates —O—P(=O)(OH)—. Superscript "m" indicates 5-methylcytosines. "A$_{do'}$-GalNAc$_3$-1$_a$" indicates a conjugate having the structure GalNAc$_3$-1 shown in Example 9 attached to the 3'-end of the antisense oligonucleotide, as indicated.

TABLE 31

Proinflammatory Effect of ASOs targeting ApoC III in hPBMC assay

| ASO | EC$_{50}$ (µM) | E$_{max}$ (µM) | E$_{max}$/EC$_{50}$ | 3' Conjugate | Internucleoside Linkage/Length | SEQ ID No. |
|---|---|---|---|---|---|---|
| ISIS 353512 (high responder) | 0.01 | 265.9 | 26,590 | None | PS/20 | 106 |
| ISIS 304801 | 0.07 | 106.55 | 1,522 | None | PS/20 | 32 |
| ISIS 647535 | 0.12 | 138 | 1,150 | GalNAc$_3$-1 | PS/20 | 111 |
| ISIS 616468 | 0.32 | 71.52 | 224 | None | PS/PO/20 | 32 |

Example 25

Effect of GalNAc$_3$-1 Conjugated Modified ASO Targeting Human ApoC III In Vitro ISIS 304801 and 647535 described above were tested in vitro. Primary hepatocyte cells from transgenic mice at a density of 25,000 cells per well were treated with 0.03, 0.08, 0.24, 0.74, 2.22, 6.67 and 20 µM concentrations of modified oligonucleotides. After a treatment period of approximately 16 hours, RNA was isolated from the cells and mRNA levels were measured by quantitative real-time PCR and the hApoC III mRNA levels were adjusted according to total RNA content, as measured by RIBOGREEN.

The IC$_{50}$ was calculated using the standard methods and the results are presented in Table 32. As illustrated, comparable potency was observed in cells treated with ISIS 647535 as compared to the control, ISIS 304801.

TABLE 32

Modified ASO targeting human ApoC III in primary hepatocytes

| ASO | IC$_{50}$ (µM) | 3' Conjugate | Internucleoside linkage/Length | SEQ ID No. |
|---|---|---|---|---|
| ISIS 304801 | 0.44 | None | PS/20 | 32 |
| ISIS 647535 | 0.31 | GalNAc$_3$-1 | PS/20 | 111 |

In this experiment, the large potency benefits of GalNAc$_3$-1 conjugation that are observed in vivo were not observed in vitro. Subsequent free uptake experiments in primary hepatocytes in vitro did show increased potency of oligonucleotides comprising various GalNAc conjugates relative to oligonucleotides that lacking the GalNAc conjugate. (see Examples 60, 82, and 92)

Example 26

Effect of PO/PS Linkages on ApoC III ASO Activity

Human ApoC III transgenic mice were injected intraperitoneally once at 25 mg/kg of ISIS 304801, or ISIS 616468 (both described above) or with PBS treated control once per week for two weeks. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III protein levels in the liver as described above (Example 20). Data from those analyses are presented in Table 33, below.

These results show reduction in potency for antisense compounds with PO/PS (ISIS 616468) in the wings relative to full PS (ISIS 304801).

TABLE 33

Effect of ASO treatment on ApoC III protein levels in human ApoC III transgenic mice

| ASO | Dose (mg/kg) | % PBS | 3' Conjugate | Internucleoside linkage/Length | SEQ ID No. |
|---|---|---|---|---|---|
| PBS | 0 | 99 | — | — | |
| ISIS 304801 | 25 mg/kg/wk for 2 wks | 24 | None | Full PS | 32 |
| ISIS 616468 | 25 mg/kg/wk for 2 wks | 40 | None | 14 PS/6 PO | 32 |

Example 27

Compound 56

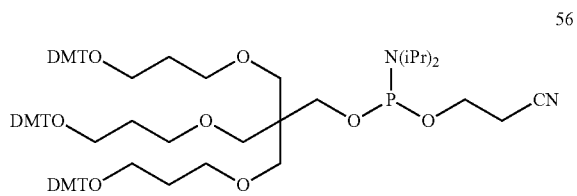

Compound 56 is commercially available from Glen Research or may be prepared according to published procedures reported by Shchepinov et al., *Nucleic Acids Research*, 1997, 25(22), 4447-4454.

Example 28

Preparation of Compound 60

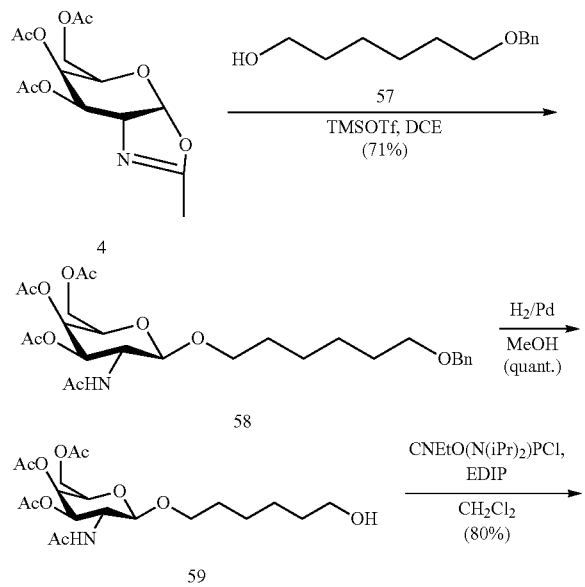

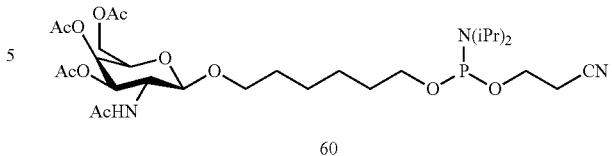

Compound 4 was prepared as per the procedures illustrated in Example 2. Compound 57 is commercially available. Compound 60 was confirmed by structural analysis.

Compound 57 is meant to be representative and not intended to be limiting as other monoprotected substituted or unsubstituted alkyl diols including but not limited to those presented in the specification herein can be used to prepare phosphoramidites having a predetermined composition.

Example 29

Preparation of Compound 63

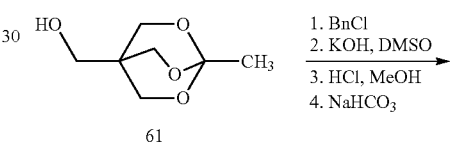

Compounds 61 and 62 are prepared using procedures similar to those reported by Tober et al., *Eur. J. Org. Chem.*, 2013, 3, 566-577; and Jiang et al., *Tetrahedron*, 2007, 63(19), 3982-3988.

Alternatively, Compound 63 is prepared using procedures similar to those reported in scientific and patent literature by Kim et al., *Synlett*, 2003, 12, 1838-1840; and Kim et al., published PCT International Application, WO 2004063208.

Example 30
Preparation of Compound 63b
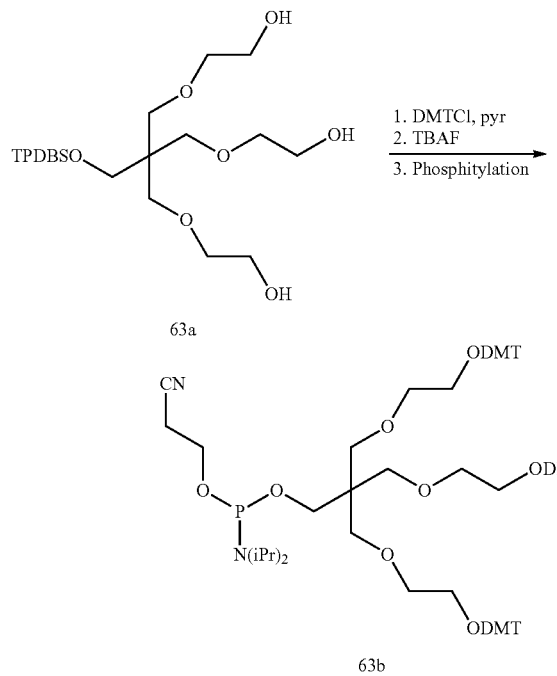
Compound 63a is prepared using procedures similar to those reported by Hanessian et al., *Canadian Journal of Chemistry*, 1996, 74(9), 1731-1737.
Example 31
Preparation of Compound 63d
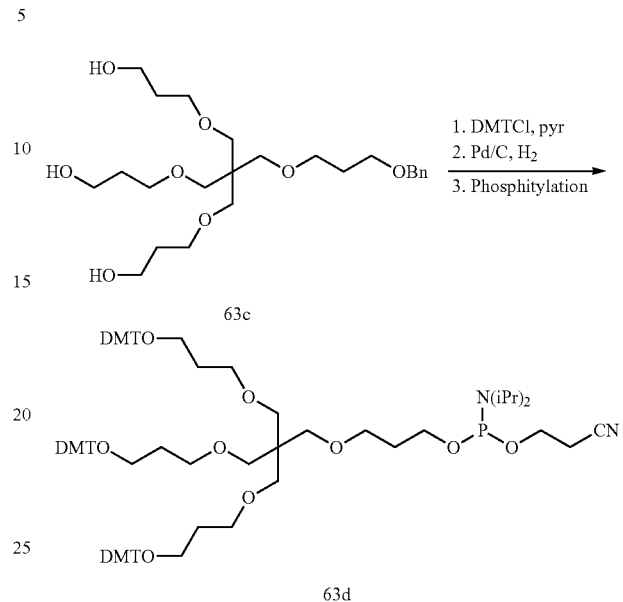
Compound 63c is prepared using procedures similar to those reported by Chen et al., *Chinese Chemical Letters*, 1998, 9(5), 451-453.
Example 32
Preparation of Compound 67
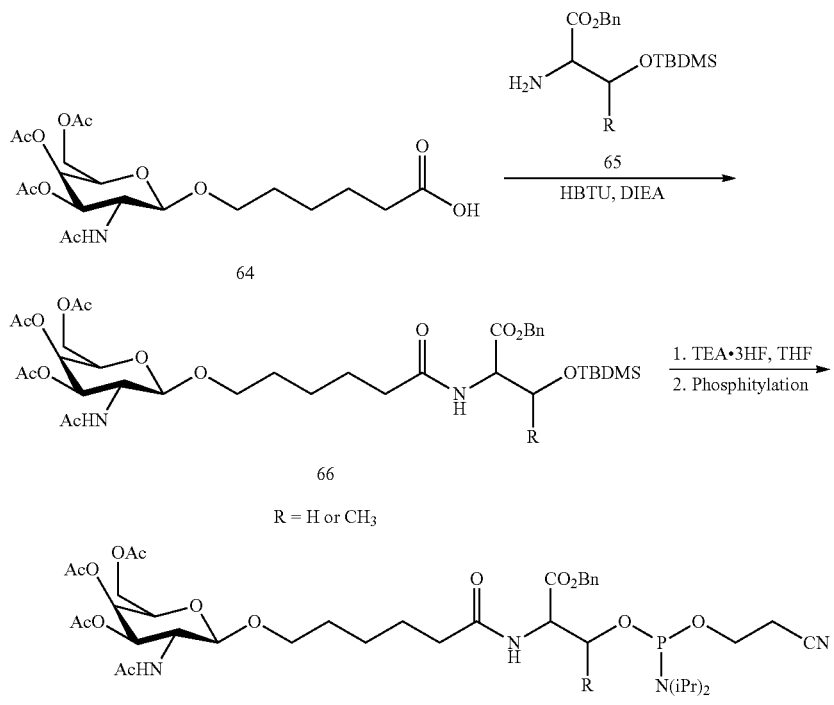
R = H or CH₃

Compound 64 was prepared as per the procedures illustrated in Example 2. Compound 65 is prepared using procedures similar to those reported by Or et al., published PCT International Application, WO 2009003009. The protecting groups used for Compound 65 are meant to be representative and not intended to be limiting as other protecting groups including but not limited to those presented in the specification herein can be used.

Example 33

Preparation of Compound 70

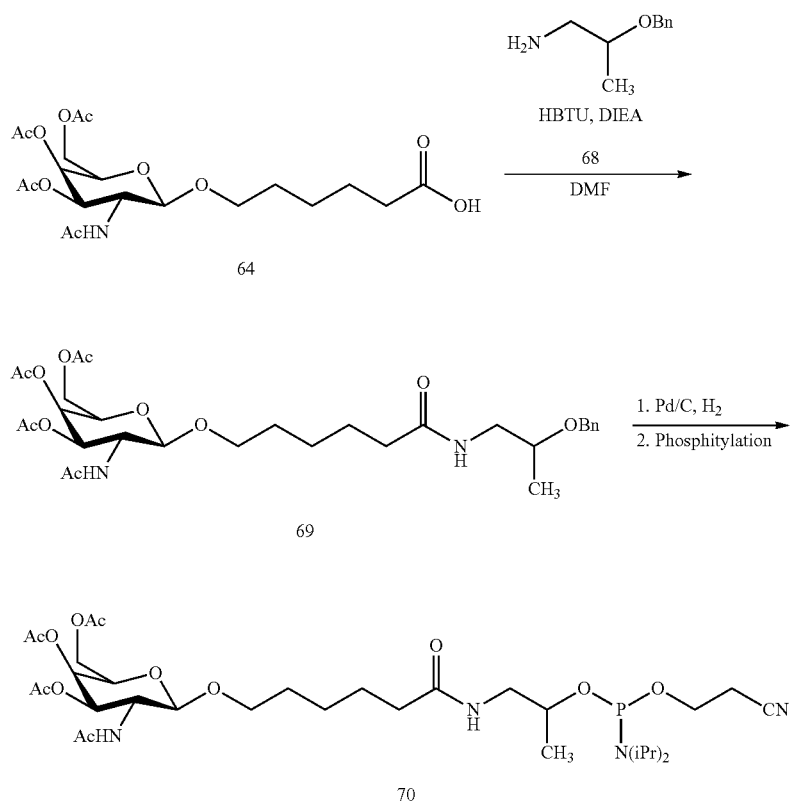

Compound 64 was prepared as per the procedures illustrated in Example 2. Compound 68 is commercially available. The protecting group used for Compound 68 is meant to be representative and not intended to be limiting as other protecting groups including but not limited to those presented in the specification herein can be used.

Example 34

Preparation of Compound 75a

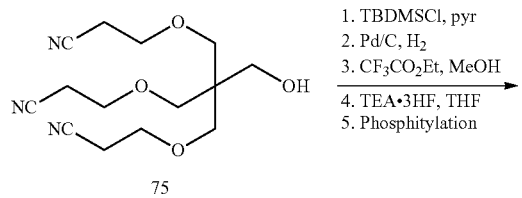

Compound 75 is prepared according to published procedures reported by Shchepinov et al., *Nucleic Acids Research*, 1997, 25(22), 4447-4454.

Example 35
Preparation of Compound 79
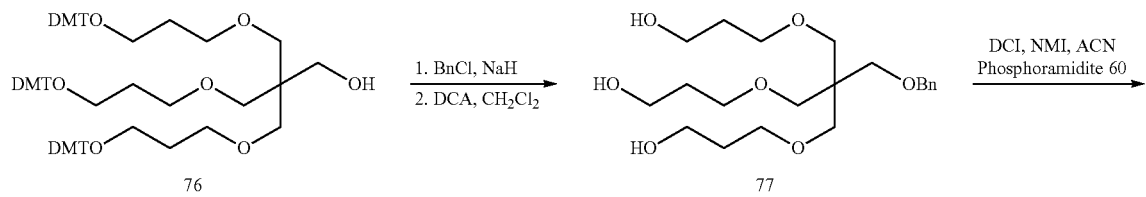
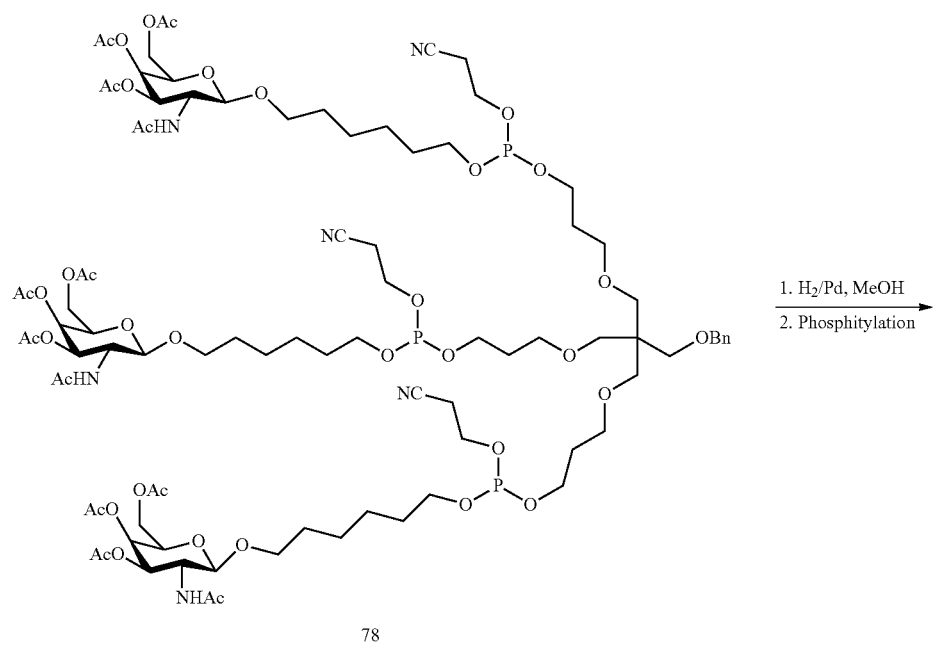
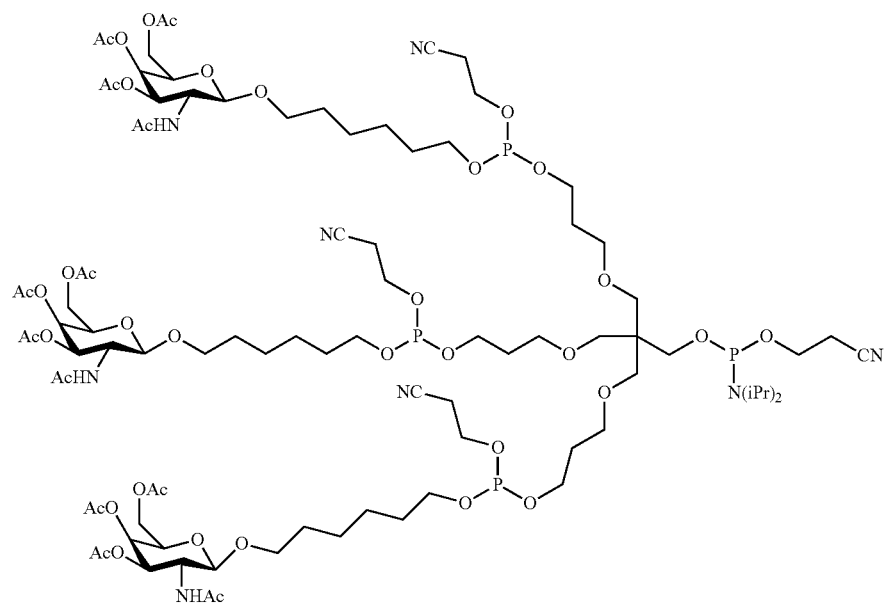

Compound 76 was prepared according to published procedures reported by Shchepinov et al., *Nucleic Acids Research*, 1997, 25(22), 4447-4454.

Example 36

Preparation of Compound 79a

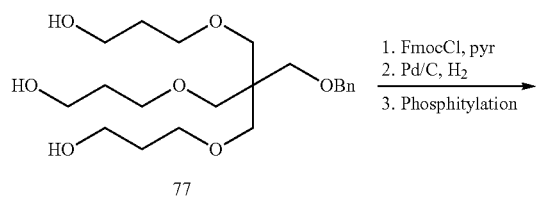

77

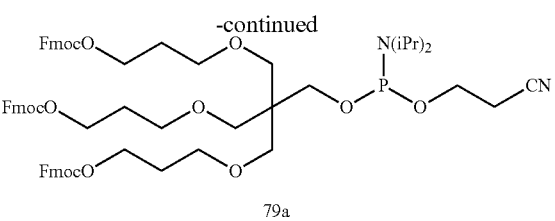

79a

Compound 77 is prepared as per the procedures illustrated in Example 35.

Example 37

General Method for the Preparation of Conjugated Oligomeric Compound 82 Comprising a Phosphodiester Linked GalNAc$_3$-2 Conjugate at 5' Terminus Via Solid Support (Method I)

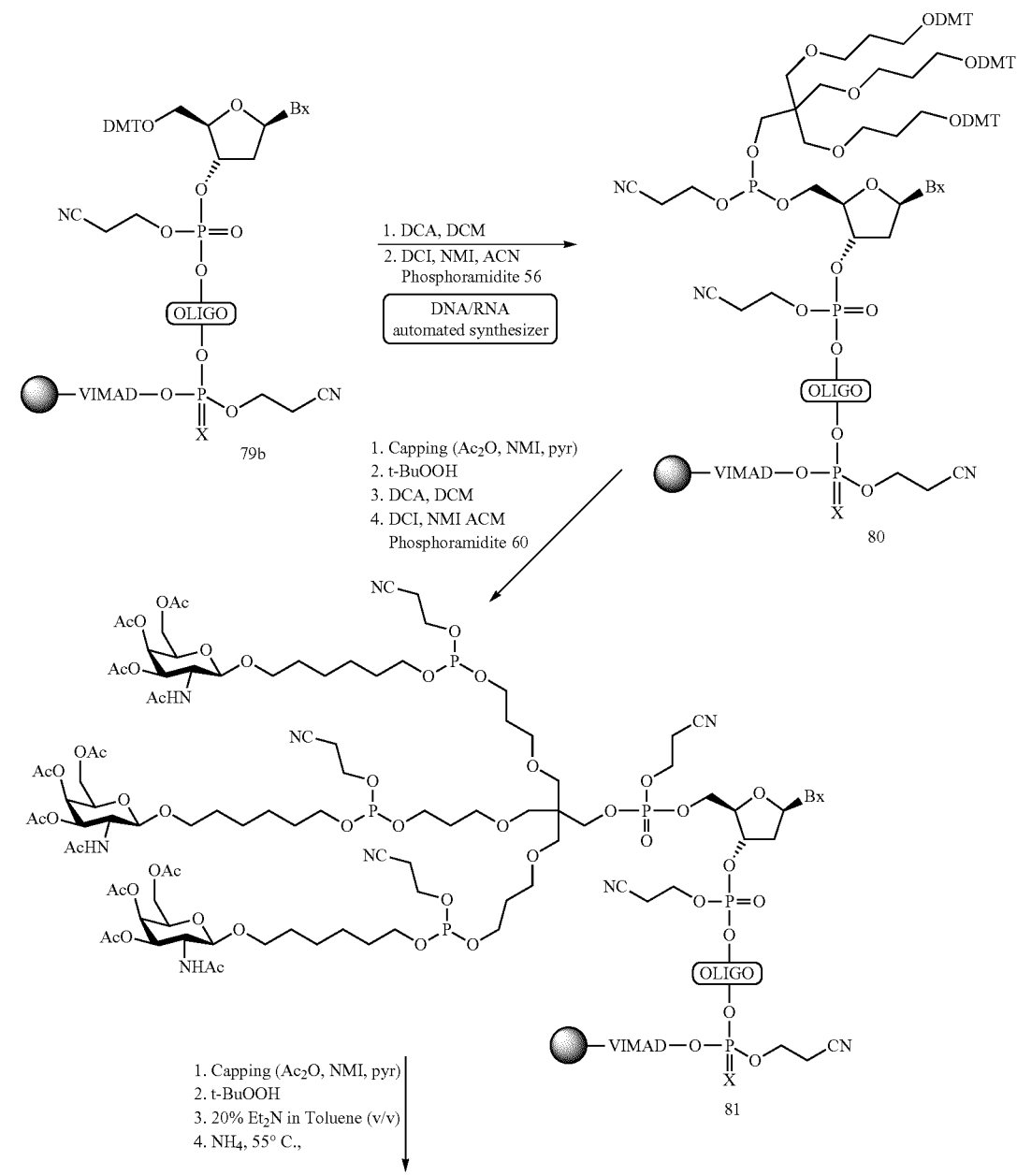

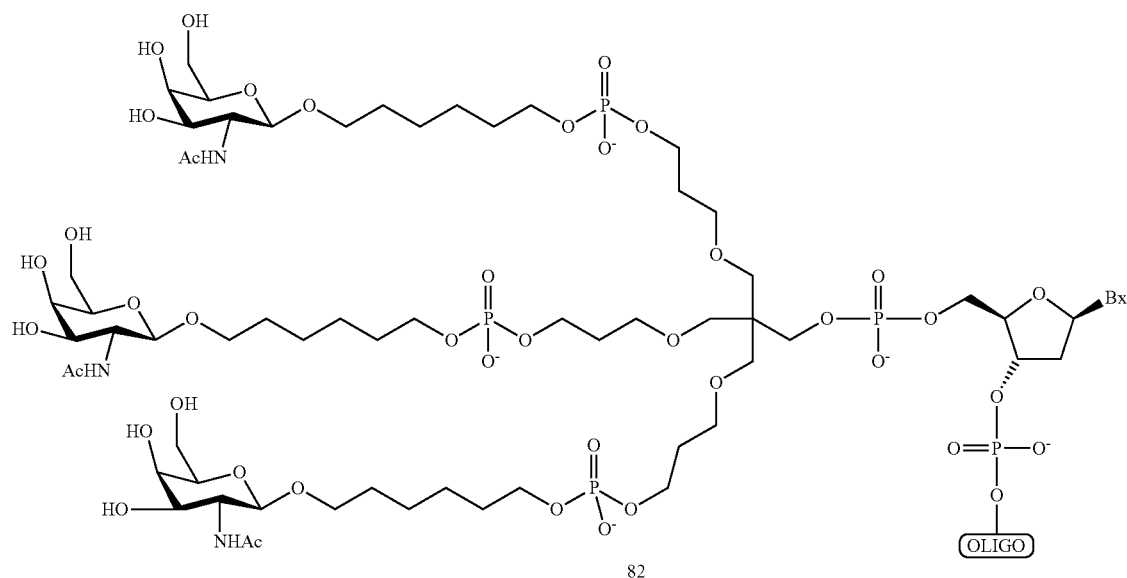
82
X = S⁻ or O⁻
Bx = Heterocyclic base
wherein GalNAc₃-2 has the structure:
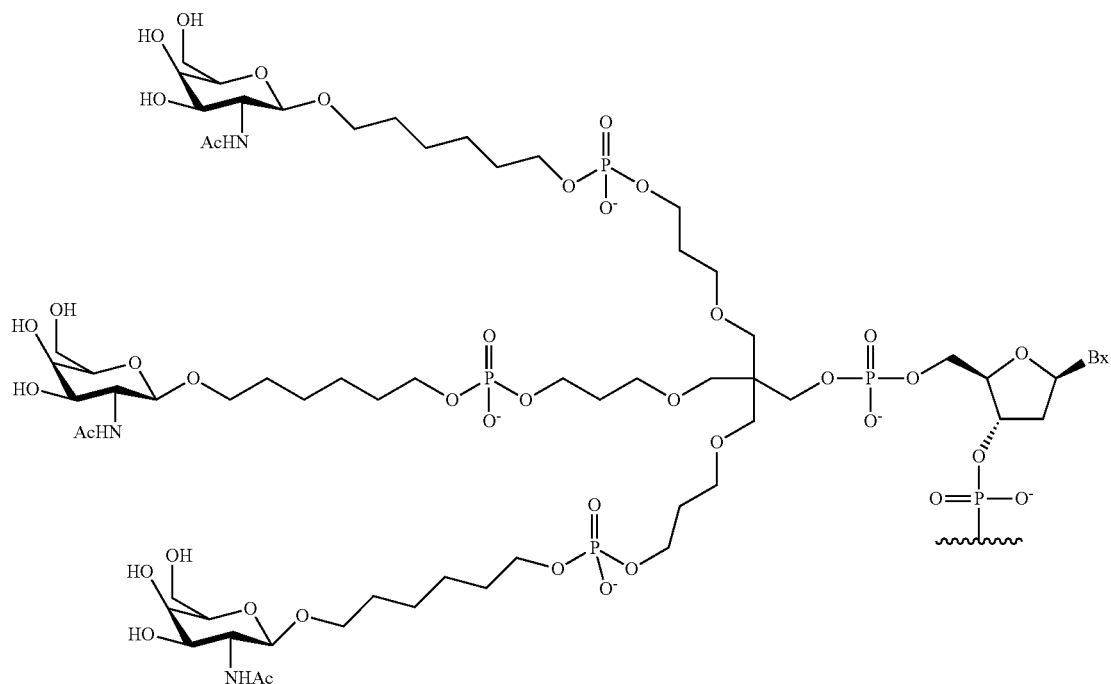

The GalNAc₃ cluster portion of the conjugate group GalNAc₃-2 (GalNAc₃-2ₐ) can be combined with any cleavable moiety to provide a variety of conjugate groups. Wherein GalNAc₃-2ₐ has the formula:

prepare an oligomeric compound having a phosphodiester linked conjugate group at the 5' terminus. The order and quantity of phosphoramidites added to the solid support can be adjusted to prepare the oligomeric compounds as

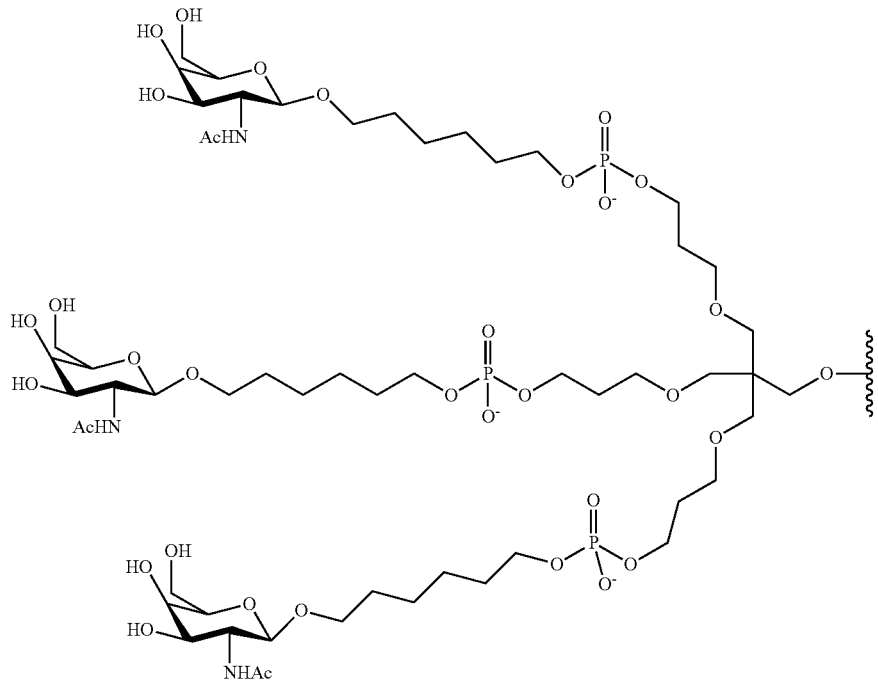

The VIMAD-bound oligomeric compound 79b was prepared using standard procedures for automated DNA/RNA synthesis (see Dupouy et al., *Angew. Chem. Int. Ed,* 2006, 45, 3623-3627). The phosphoramidite Compounds 56 and 60 were prepared as per the procedures illustrated in Examples 27 and 28, respectively. The phosphoramidites illustrated are meant to be representative and not intended to be limiting as other phosphoramidite building blocks including but not limited those presented in the specification herein can be used to described herein having any predetermined sequence and composition.

Example 38

Alternative Method for the Preparation of Oligomeric Compound 82 Comprising a Phosphodiester Linked GalNAc₃-2 Conjugate at 5' Terminus (Method II)

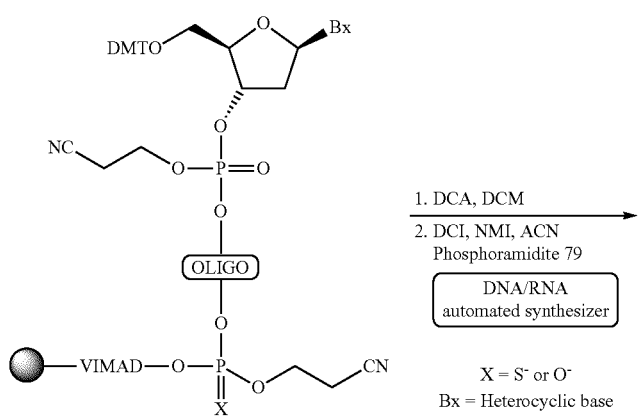

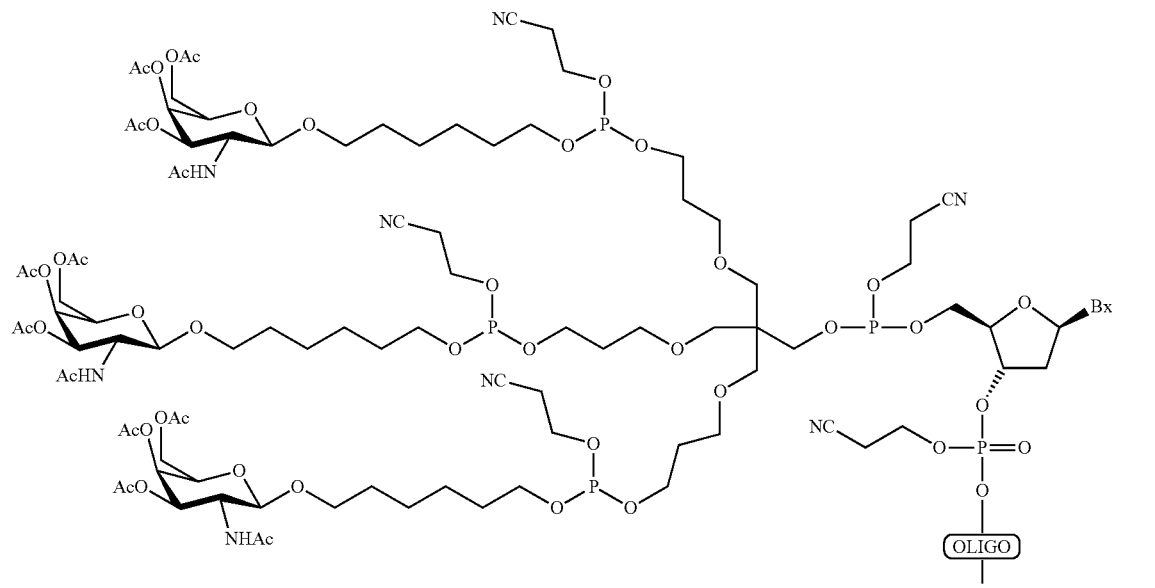

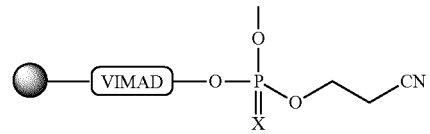

83

1. Capping
2. t-BuOOH
3. Et₃N:CH₃CN (1:1 v/v)
4. NH₄, 55° C.

Oligomeric Compound 82

The VIMAD-bound oligomeric compound 79b was prepared using standard procedures for automated DNA/RNA synthesis (see Dupouy et al., *Angew. Chem. Int. Ed,* 2006, 45, 3623-3627). The GalNAc$_3$-2 cluster phosphoramidite, Compound 79 was prepared as per the procedures illustrated in Example 35. This alternative method allows a one-step installation of the phosphodiester linked GalNAc$_3$-2 conjugate to the oligomeric compound at the final step of the synthesis. The phosphoramidites illustrated are meant to be representative and not intended to be limiting, as other phosphoramidite building blocks including but not limited to those presented in the specification herein can be used to prepare oligomeric compounds having a phosphodiester conjugate at the 5' terminus. The order and quantity of phosphoramidites added to the solid support can be adjusted to prepare the oligomeric compounds as described herein having any predetermined sequence and composition.

Example 39

General Method for the Preparation of Oligomeric Compound 83h Comprising a GalNAc$_3$-3 Conjugate at the 5' Terminus (GalNAc$_3$-1 Modified for 5' End Attachment) Via Solid Support

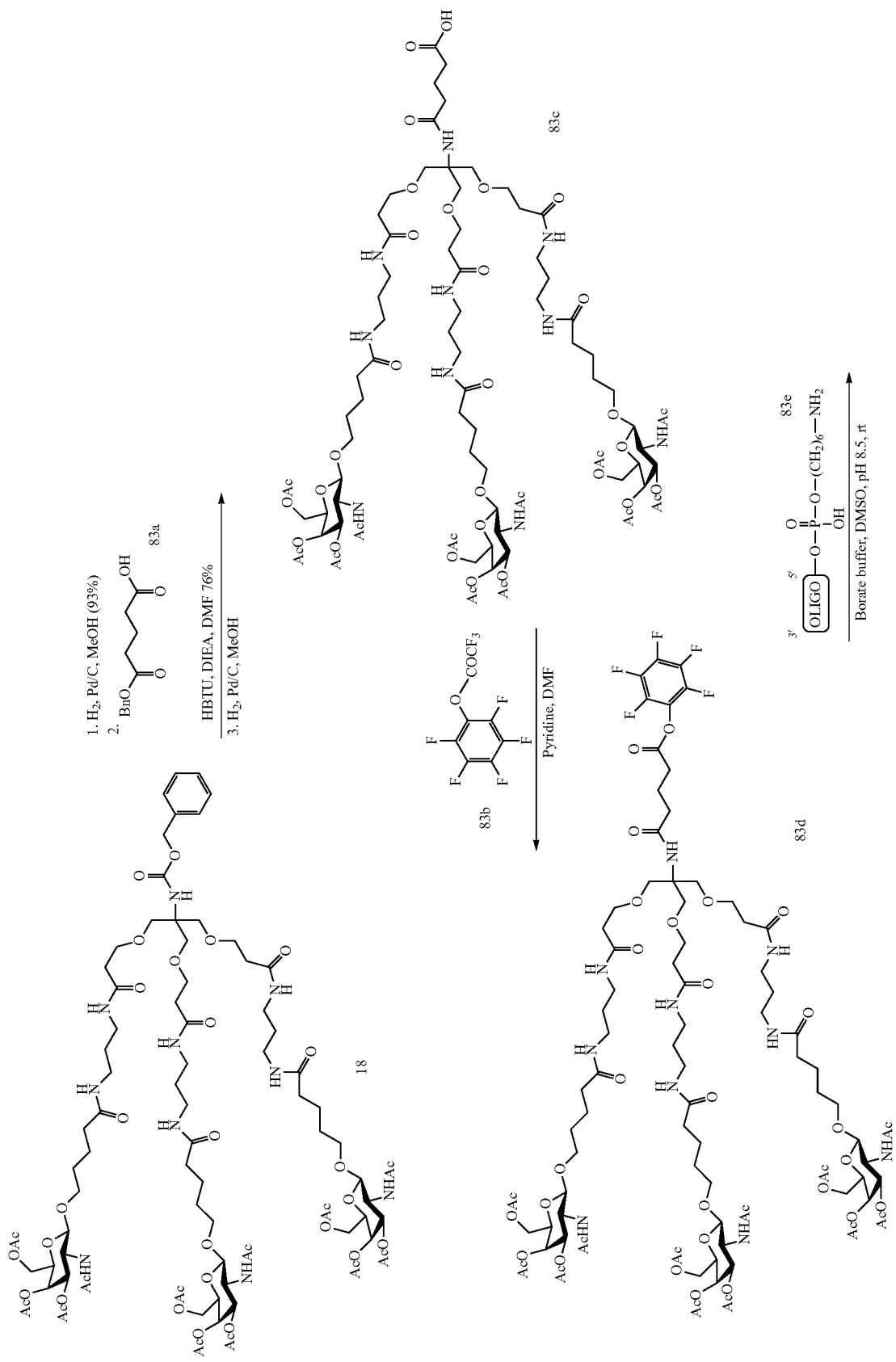

-continued
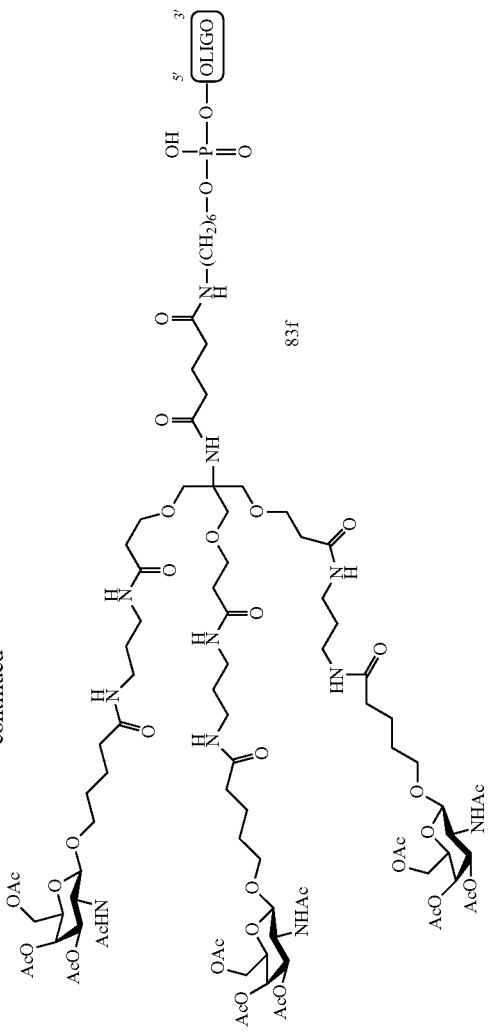
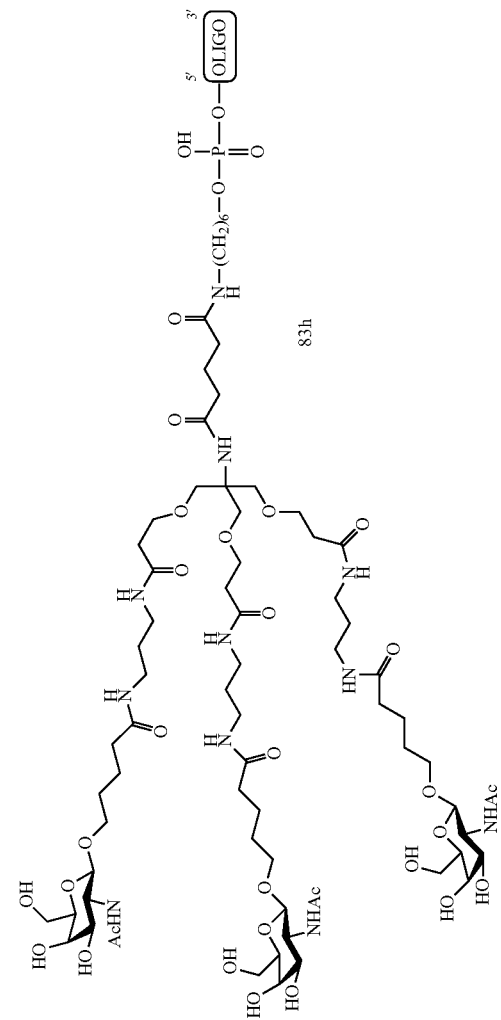

Compound 18 was prepared as per the procedures illustrated in Example 4. Compounds 83a and 83b are commercially available. Oligomeric Compound 83e comprising a phosphodiester linked hexylamine was prepared using standard oligonucleotide synthesis procedures. Treatment of the protected oligomeric compound with aqueous ammonia provided the 5'-GalNAc$_3$-3 conjugated oligomeric compound (83h).

Wherein GalNAc$_3$-3 has the structure:

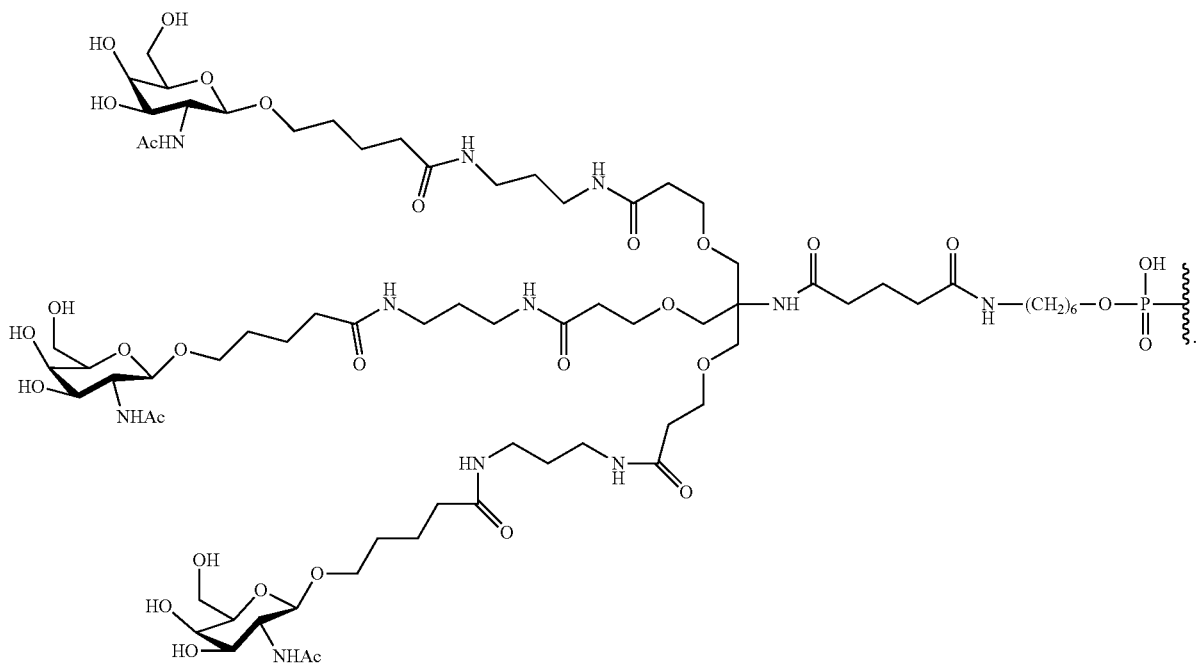

The GalNAc$_3$ cluster portion of the conjugate group GalNAc$_3$-3 (GalNAc$_3$-3$_a$) can be combined with any cleavable moiety to provide a variety of conjugate groups. Wherein GalNAc$_3$-3$_a$ has the formula:

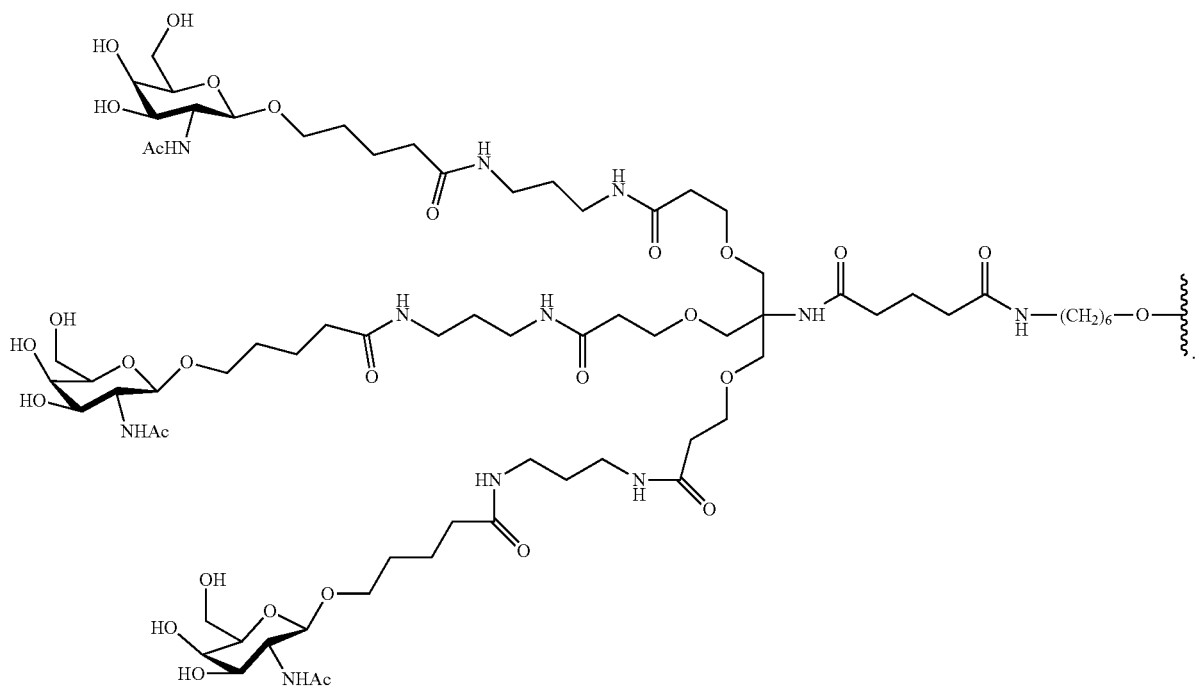

Example 40
General Method for the Preparation of Oligomeric Compound 89 Comprising a Phosphodiester Linked GalNAc$_3$-4 Conjugate at the 3' Terminus Via Solid Support
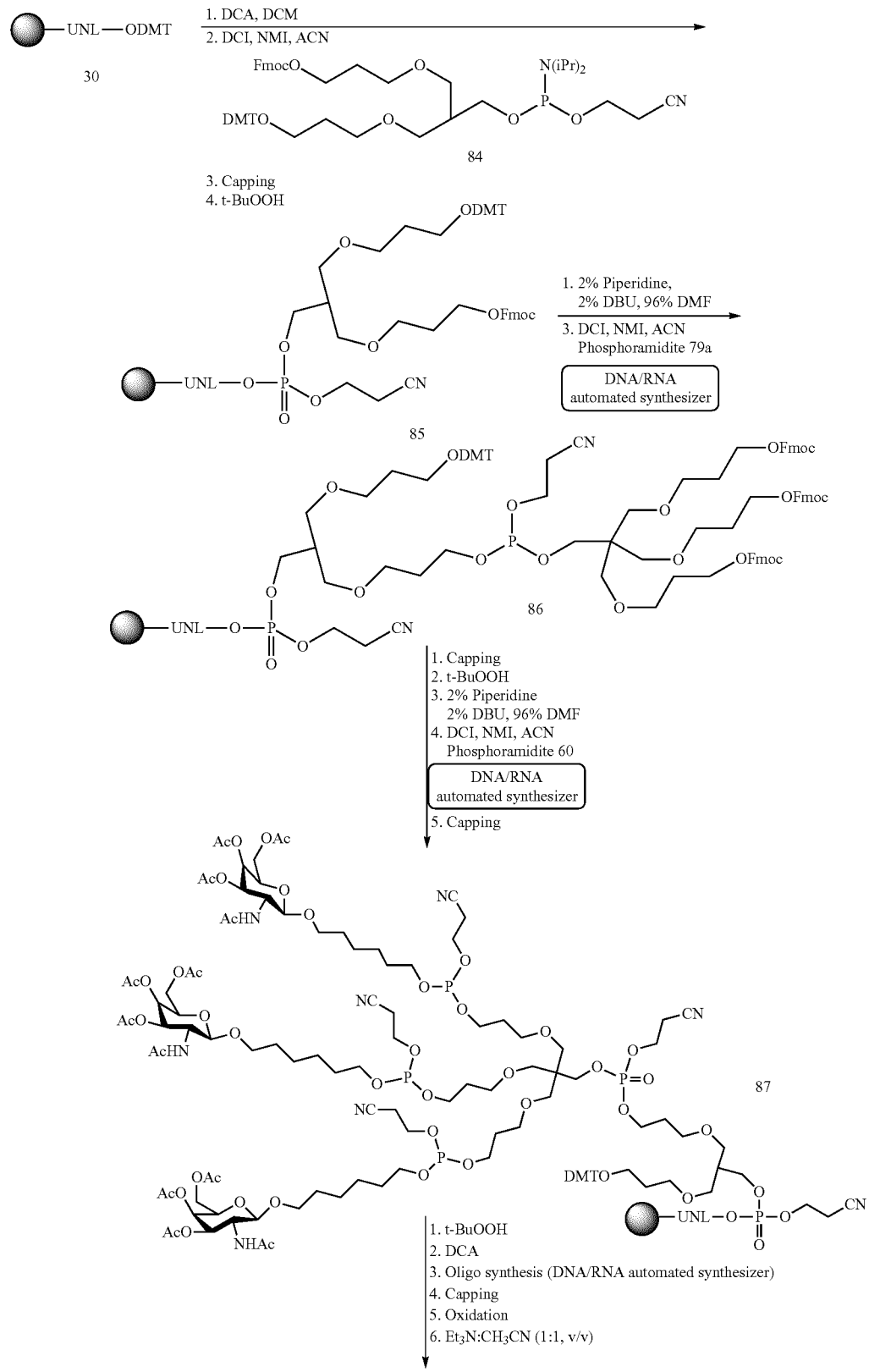

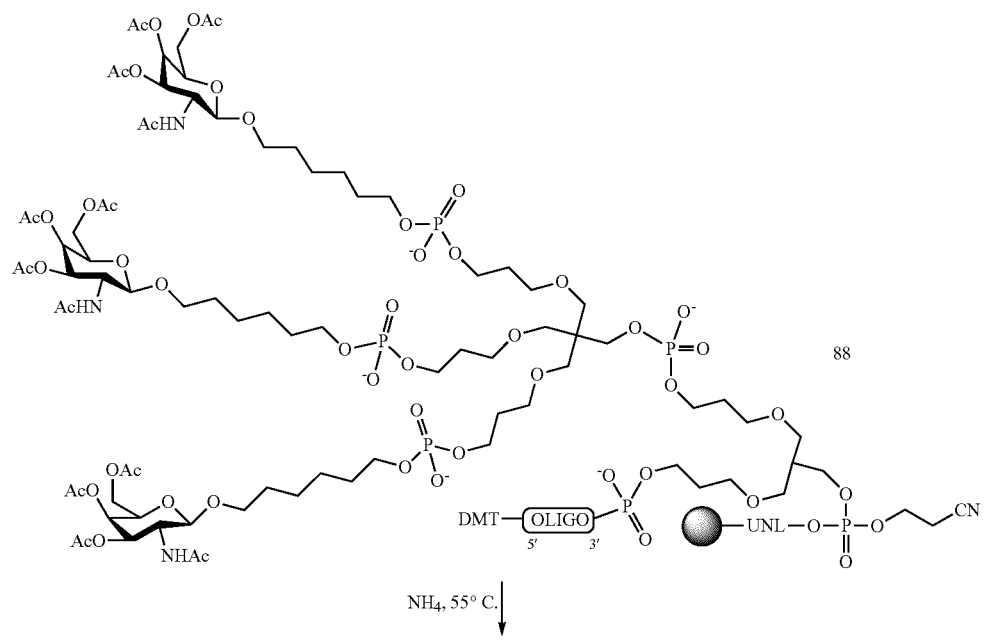
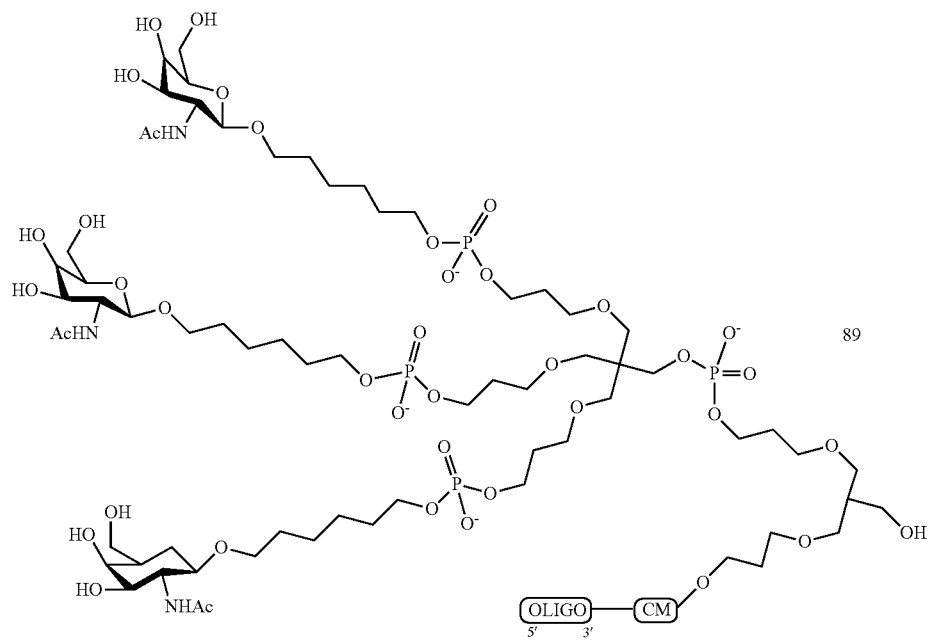

Wherein GalNAc₃-4 has the structure:
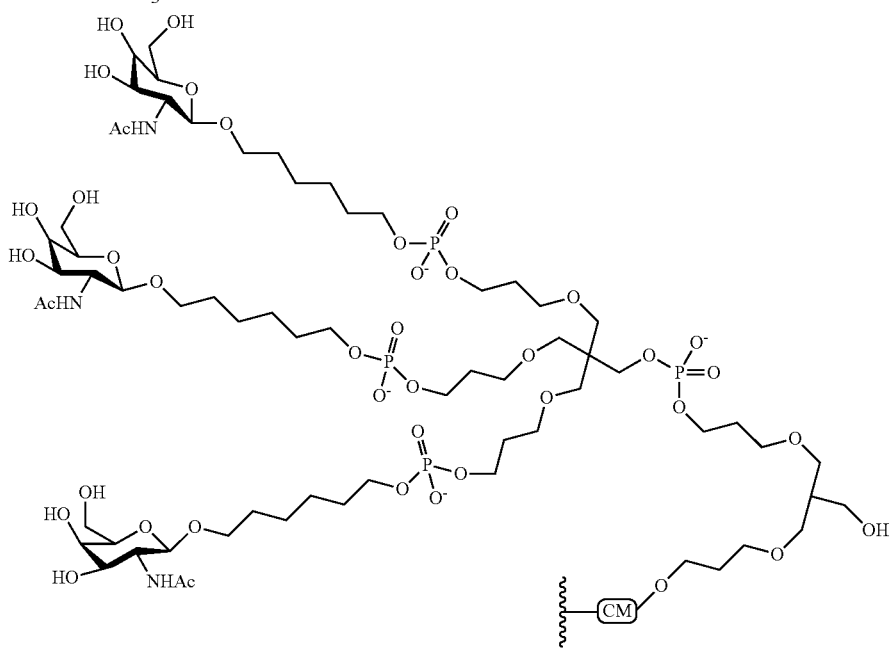
Wherein CM is a cleavable moiety. In certain embodiments, cleavable moiety is:
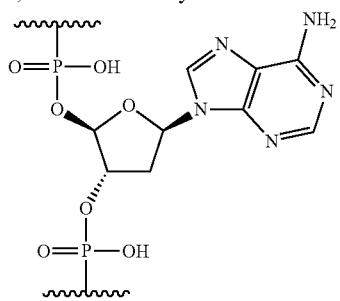
The GalNAc₃ cluster portion of the conjugate group GalNAc₃-4 (GalNAc₃-4$_a$) can be combined with any cleavable moiety to provide a variety of conjugate groups. Wherein GalNAc₃-4$_a$ has the formula:
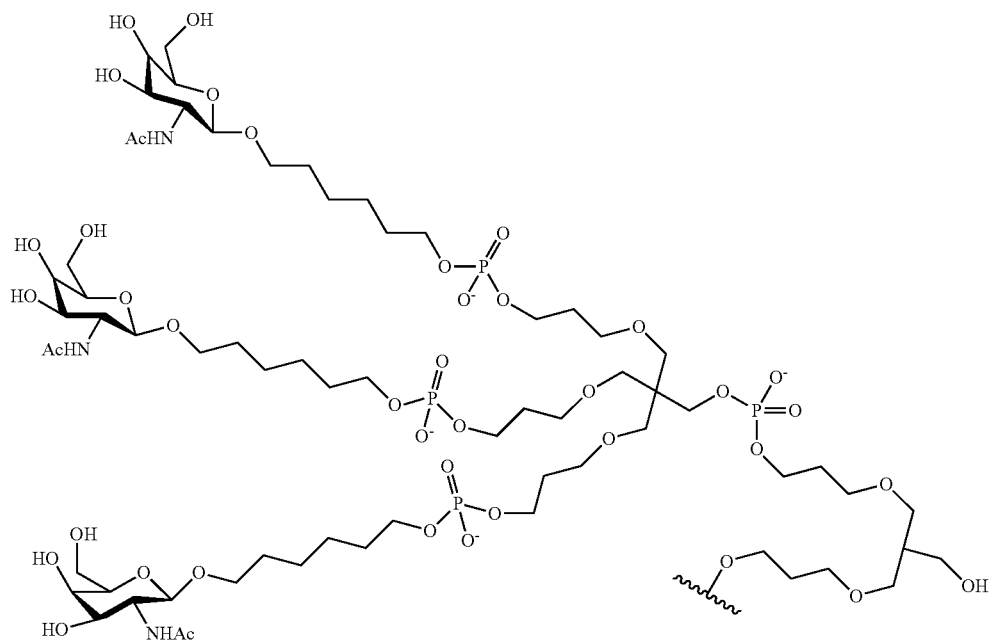

The protected Unylinker functionalized solid support Compound 30 is commercially available. Compound 84 is prepared using procedures similar to those reported in the literature (see Shchepinov et al., *Nucleic Acids Research*, 1997, 25(22), 4447-4454; Shchepinov et al., *Nucleic Acids Research*, 1999, 27, 3035-3041; and Hornet et al., *Nucleic Acids Research*, 1997, 25, 4842-4849).

The phosphoramidite building blocks, Compounds 60 and 79a are prepared as per the procedures illustrated in Examples 28 and 36. The phosphoramidites illustrated are meant to be representative and not intended to be limiting as other phosphoramidite building blocks can be used to prepare an oligomeric compound having a phosphodiester linked conjugate at the 3' terminus with a predetermined sequence and composition. The order and quantity of phosphoramidites added to the solid support can be adjusted to prepare the oligomeric compounds as described herein having any predetermined sequence and composition.

Example 41

General Method for the Preparation of ASOs Comprising a Phosphodiester Linked GalNAc$_3$-2 (See Example 37, Bx is Adenine) Conjugate at the 5' Position Via Solid Phase Techniques (Preparation of ISIS 661134)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^m$C residues.

Phosphoramidite compounds 56 and 60 were used to synthesize the phosphodiester linked GalNAc$_3$-2 conjugate at the 5' terminus. A 0.1 M solution of phosphoramidite in anhydrous acetonitrile was used for β-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on VIMAD solid support (110 μmol/g, Guzaev et al., 2003) packed in the column. For the coupling step, the phosphoramidites were delivered at a 4 fold excess over the initial loading of the solid support and phosphoramidite coupling was carried out for 10 min. All other steps followed standard protocols supplied by the manufacturer. A solution of 6% dichloroacetic acid in toluene was used for removing the dimethoxytrityl (DMT) groups from 5'-hydroxyl groups of the nucleotide. 4,5-Dicyanoimidazole (0.7 M) in anhydrous CH$_3$CN was used as activator during the coupling step. Phosphorothioate linkages were introduced by sulfurization with 0.1 M solution of xanthane hydride in 1:1 pyridine/CH$_3$CN for a contact time of 3 minutes. A solution of 20% tert-butylhydroperoxide in CH$_3$CN containing 6% water was used as an oxidizing agent to provide phosphodiester internucleoside linkages with a contact time of 12 minutes.

After the desired sequence was assembled, the cyanoethyl phosphate protecting groups were deprotected using a 20% diethylamine in toluene (v/v) with a contact time of 45 minutes. The solid-support bound ASOs were suspended in aqueous ammonia (28-30 wt %) and heated at 55° C. for 6 h. The unbound ASOs were then filtered and the ammonia was boiled off. The residue was purified by high pressure liquid chromatography on a strong anion exchange column (GE Healthcare Bioscience, Source 30Q, 30 μm, 2.54×8 cm, A=100 mM ammonium acetate in 30% aqueous CH$_3$CN, B=1.5 M NaBr in A, 0-40% of B in 60 min, flow 14 mL min-1, λ=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

TABLE 34

ASO comprising a phosphodiester linked GalNAc$_3$-2 conjugate at the 5' position targeting SRB-1

| ISIS No. | Sequence (5' to 3') | CalCd Mass | Observed Mass | SEQ ID No. |
|---|---|---|---|---|
| 661134 | GalNAc$_3$-2$_{a-o'}$A$_{do}$T$_{ks}$$^m$C$_{ks}$ A$_{ds}$G$_{ds}$T$_{ds}$$^m$C$_{ds}$A$_{ds}$T$_{ds}$G$_{ds}$A$_{ds}$$^m$ C$_{ds}$T$_{ds}$T$_{ks}$$^m$C$_k$ | 6482.2 | 6481.6 | 114 |

Subscripts:
"e" indicates 2'-MOE modified nucleoside;
"d" indicates (β-D-2'-deoxyribonucleoside;
"k" indicates 6'-(S)-CH$_3$ bicyclic nucleoside (e.g. cEt);
"s" indicates phosphorothioate internucleoside linkages (PS);
"o" indicates phosphodiester internucleoside linkages (PO);
and "o'" indicates —O—P(═O)(OH)—.
Superscript "m" indicates 5-methylcytosines.
The structure of GalNAc$_3$-2$_a$ is shown in Example 37.

Example 42

General Method for the Preparation of ASOs Comprising a GalNAc$_3$-3 Conjugate at the 5' Position Via Solid Phase Techniques (Preparation of ISIS 661166)

The synthesis for ISIS 661166 was performed using similar procedures as illustrated in Examples 39 and 41.

ISIS 661166 is a 5-10-5 MOE gapmer, wherein the 5' position comprises a GalNAc$_3$-3 conjugate. The ASO was characterized by ion-pair-HPLC coupled MS analysis with Agilent 1100 MSD system.

TABLE 34a

ASO comprising a GalNAc$_3$-3 conjugate at the 5' position via a hexylamino phosphodiester linkage targeting Malat-1

| ISIS No. | Sequence (5' to 3') | Conjugate | Calcd Mass | Observed Mass | SEQ ID No. |
|---|---|---|---|---|---|
| 661166 | 5'-GalNAc$_3$-3$_{a\text{-}o'}$$^m$C$_{es}$G$_{es}$G$_{es}$T$_{es}$ G$_{es}$$^m$C$_{ds}$A$_{ds}$A$_{ds}$G$_{ds}$G$_{ds}$$^m$C$_{ds}$T$_{ds}$T$_{ds}$A$_{ds}$ G$_{ds}$G$_{es}$A$_{es}$A$_{es}$T$_{es}$T$_{e}$ | 5'-GalNAc$_3$-3 | 8992.16 | 8990.51 | 107 |

Subscripts:
"e" indicates 2'-MOE modified nucleoside;
"d" indicates β-D-2'-deoxyribonucleoside;
"s" indicates phosphorothioate internucleoside linkages (PS);
"o" indicates phosphodiester internucleoside linkages (PO);
and "o'" indicates -O-P(=O)(OH)-.
Superscript "m" indicates 5-methylcytosines.
The structure of "5'-GalNAc$_3$-3$_a$" is shown in Example 39.

Example 43

Dose-Dependent Study of Phosphodiester Linked GalNAc$_3$-2 (See Examples 37 and 41, Bx is Adenine) at the 5' Terminus Targeting SRB-1 In Vivo ISIS 661134 (see Example 41) comprising a phosphodiester linked GalNAc$_3$-2 conjugate at the 5' terminus was tested in a dose-dependent study for antisense inhibition of SRB-1 in mice. Unconjugated ISIS 440762 and 651900 (GalNAc$_3$-1 conjugate at 3' terminus, see Example 9) were included in the study for comparison and are described previously in Table 17.

Treatment

Six week old male Balb/c mice (Jackson Laboratory, Bar Harbor, Me.) were injected subcutaneously once at the dosage shown below with ISIS 440762, 651900, 661134 or with PBS treated control. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The ED$_{50}$s were measured using similar methods as described previously and are presented below.

As illustrated in Table 35, treatment with antisense oligonucleotides lowered SRB-1 mRNA levels in a dose-dependent manner. Indeed, the antisense oligonucleotides comprising the phosphodiester linked GalNAc$_3$-2 conjugate at the 5' terminus (ISIS 661134) or the GalNAc$_3$-1 conjugate linked at the 3' terminus (ISIS 651900) showed substantial improvement in potency compared to the unconjugated antisense oligonucleotide (ISIS 440762). Further, ISIS 661134, which comprises the phosphodiester linked GalNAc$_3$-2 conjugate at the 5' terminus was equipotent compared to ISIS 651900, which comprises the GalNAc$_3$-1 conjugate at the 3' terminus.

TABLE 35

ASOs containing GalNAc$_3$-1 or GalNAc$_3$-2 targeting SRB-1

| ISIS No. | Dosage (mg/kg) | SRB-1 mRNA levels (% PBS) | ED$_{50}$ (mg/kg) | Conjugate | SEQ ID No. |
|---|---|---|---|---|---|
| PBS | 0 | 100 | — | — | |
| 440762 | 0.2 | 116 | 2.58 | No conjugate | 104 |
|  | 0.7 | 91 |  |  |  |
|  | 2 | 69 |  |  |  |
|  | 7 | 22 |  |  |  |
|  | 20 | 5 |  |  |  |
| 651900 | 0.07 | 95 | 0.26 | 3' GalNAc$_3$-1 | 112 |
|  | 0.2 | 77 |  |  |  |
|  | 0.7 | 28 |  |  |  |
|  | 2 | 11 |  |  |  |
|  | 7 | 8 |  |  |  |
| 661134 | 0.07 | 107 | 0.25 | 5' GalNAc$_3$-2 | 114 |
|  | 0.2 | 86 |  |  |  |
|  | 0.7 | 28 |  |  |  |
|  | 2 | 10 |  |  |  |
|  | 7 | 6 |  |  |  |

Structures for 3' GalNAc$_3$-1 and 5' GalNAc$_3$-2 were described previously in Examples 9 and 37.

Pharmacokinetics Analysis (PK)

The PK of the ASOs from the high dose group (7 mg/kg) was examined and evaluated in the same manner as illustrated in Example 20. Liver sample was minced and extracted using standard protocols. The full length metabolites of 661134 (5' GalNAc$_3$-2) and ISIS 651900 (3' GalNAc$_3$-1) were identified and their masses were confirmed by high resolution mass spectrometry analysis. The results showed that the major metabolite detected for the ASO comprising a phosphodiester linked GalNAc$_3$-2 conjugate at the 5' terminus (ISIS 661134) was ISIS 440762 (data not shown). No additional metabolites, at a detectable level, were observed. Unlike its counterpart, additional metabolites similar to those reported previously in Table 23a were observed for the ASO having the GalNAc$_3$-1 conjugate at the 3' terminus (ISIS 651900). These results suggest that having the phosphodiester linked GalNAc$_3$-1 or GalNAc$_3$-2 conjugate may improve the PK profile of ASOs without compromising their potency.

Example 44

Effect of PO/PS Linkages on Antisense Inhibition of ASOs Comprising GalNAc$_3$-1 Conjugate (See Example 9) at the 3' Terminus Targeting SRB-1

ISIS 655861 and 655862 comprising a GalNAc$_3$-1 conjugate at the 3' terminus each targeting SRB-1 were tested in a single administration study for their ability to inhibit SRB-1 in mice. The parent unconjugated compound, ISIS 353382 was included in the study for comparison.

The ASOs are 5-10-5 MOE gapmers, wherein the gap region comprises ten 2'-deoxyribonucleosides and each wing region comprises five 2'-MOE modified nucleosides. The ASOs were prepared using similar methods as illustrated previously in Example 19 and are described Table 36, below.

TABLE 36

Modified ASOs comprising GalNAc$_3$-1 conjugate at the 3' terminus targeting SRB-1

| ISIS No. | Sequence (5' to 3') | Chemistry | SEQ ID No. |
|---|---|---|---|
| 353382 (parent) | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$T$_{es}$T$_e$ | Full PS no conjugate | 108 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$T$_{es}$T$_{eo}$A$_{do}$,-GalNAc$_3$-1$_a$ | Full PS with GalNAc$_3$-1 conjugate | 110 |
| 655862 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_{eo}$A$_{do}$,-GalNAc$_3$-1$_a$ | Mixed PS/PO with GalNAc$_3$-1 conjugate | 110 |

Subscripts:
"e" indicates 2'-MOE modified nucleoside;
"d" indicates β-D-2'-deoxyribonucleoside;
"s" indicates phosphorothioate internucleoside linkages (PS);
"o" indicates phosphodiester internucleoside linkages (PO);
and "o'" indicates —O—P(═O)(OH)—.
Superscript "m" indicates 5-methylcytosines.
The structure of "GalNAc$_3$-1" is shown in Example 9.

Treatment

Six week old male Balb/c mice (Jackson Laboratory, Bar Harbor, Me.) were injected subcutaneously once at the dosage shown below with ISIS 353382, 655861, 655862 or with PBS treated control. Each treatment group consisted of 4 animals. Prior to the treatment as well as after the last dose, blood was drawn from each mouse and plasma samples were analyzed. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The ED$_{50}$s were measured using similar methods as described previously and are reported below.

As illustrated in Table 37, treatment with antisense oligonucleotides lowered SRB-1 mRNA levels in a dose-dependent manner compared to PBS treated control. Indeed, the antisense oligonucleotides comprising the GalNAc$_3$-1 conjugate at the 3' terminus (ISIS 655861 and 655862) showed substantial improvement in potency comparing to the unconjugated antisense oligonucleotide (ISIS 353382). Further, ISIS 655862 with mixed PS/PO linkages showed an improvement in potency relative to full PS (ISIS 655861).

TABLE 37

Effect of PO/PS linkages on antisense inhibition of ASOs comprising GalNAc$_3$-1 conjugate at 3' terminus targeting SRB-1

| ISIS No. | Dosage (mg/kg) | SRB-1 mRNA levels (% PBS) | ED$_{50}$ (mg/kg) | Chemistry | SEQ ID No. |
|---|---|---|---|---|---|
| PBS | 0 | 100 | — | — | |
| 353382 | 3 | 76.65 | 10.4 | Full PS without | 108 |
| (parent) | 10 | 52.40 | | conjugate | |
| | 30 | 24.95 | | | |
| 655861 | 0.5 | 81.22 | 2.2 | Full PS with | 110 |
| | 1.5 | 63.51 | | GalNAc$_3$-1 | |
| | 5 | 24.61 | | conjugate | |
| | 15 | 14.80 | | | |
| 655862 | 0.5 | 69.57 | 1.3 | Mixed PS/PO | 110 |
| | 1.5 | 45.78 | | with | |
| | 5 | 19.70 | | GalNAc$_3$-1 | |
| | 15 | 12.90 | | conjugate | |

Liver transaminase levels, alanine aminotransferase (ALT) and aspartate aminotransferase (AST), in serum were measured relative to saline injected mice using standard protocols. Organ weights were also evaluated. The results demonstrated that no elevation in transaminase levels (Table 38) or organ weights (data not shown) were observed in mice treated with ASOs compared to PBS control. Further, the ASO with mixed PS/PO linkages (ISIS 655862) showed similar transaminase levels compared to full PS (ISIS 655861).

TABLE 38

Effect of PO/PS linkages on transaminase levels of ASOs comprising GalNAc$_3$-1 conjugate at 3' terminus targeting SRB-1

| ISIS No. | Dosage (mg/kg) | ALT (U/L) | AST (U/L) | Chemistry | SEQ ID No. |
|---|---|---|---|---|---|
| PBS | 0 | 28.5 | 65 | — | |
| 353382 | 3 | 50.25 | 89 | Full PS without | 108 |

TABLE 38-continued

Effect of PO/PS linkages on transaminase levels of ASOs comprising GalNAc$_3$-1 conjugate at 3' terminus targeting SRB-1

| ISIS No. | Dosage (mg/kg) | ALT (U/L) | AST (U/L) | Chemistry | SEQ ID No. |
|---|---|---|---|---|---|
| (parent) | 10 | 27.5 | 79.3 | conjugate | |
|  | 30 | 27.3 | 97 | | |
| 655861 | 0.5 | 28 | 55.7 | Full PS with GalNAc$_3$-1 | 110 |
|  | 1.5 | 30 | 78 | | |
|  | 5 | 29 | 63.5 | | |
|  | 15 | 28.8 | 67.8 | | |
| 655862 | 0.5 | 50 | 75.5 | Mixed PS/PO with GalNAc$_3$-1 | 110 |
|  | 1.5 | 21.7 | 58.5 | | |
|  | 5 | 29.3 | 69 | | |
|  | 15 | 22 | 61 | | |

Example 45

Preparation of PFP Ester, Compound 110a

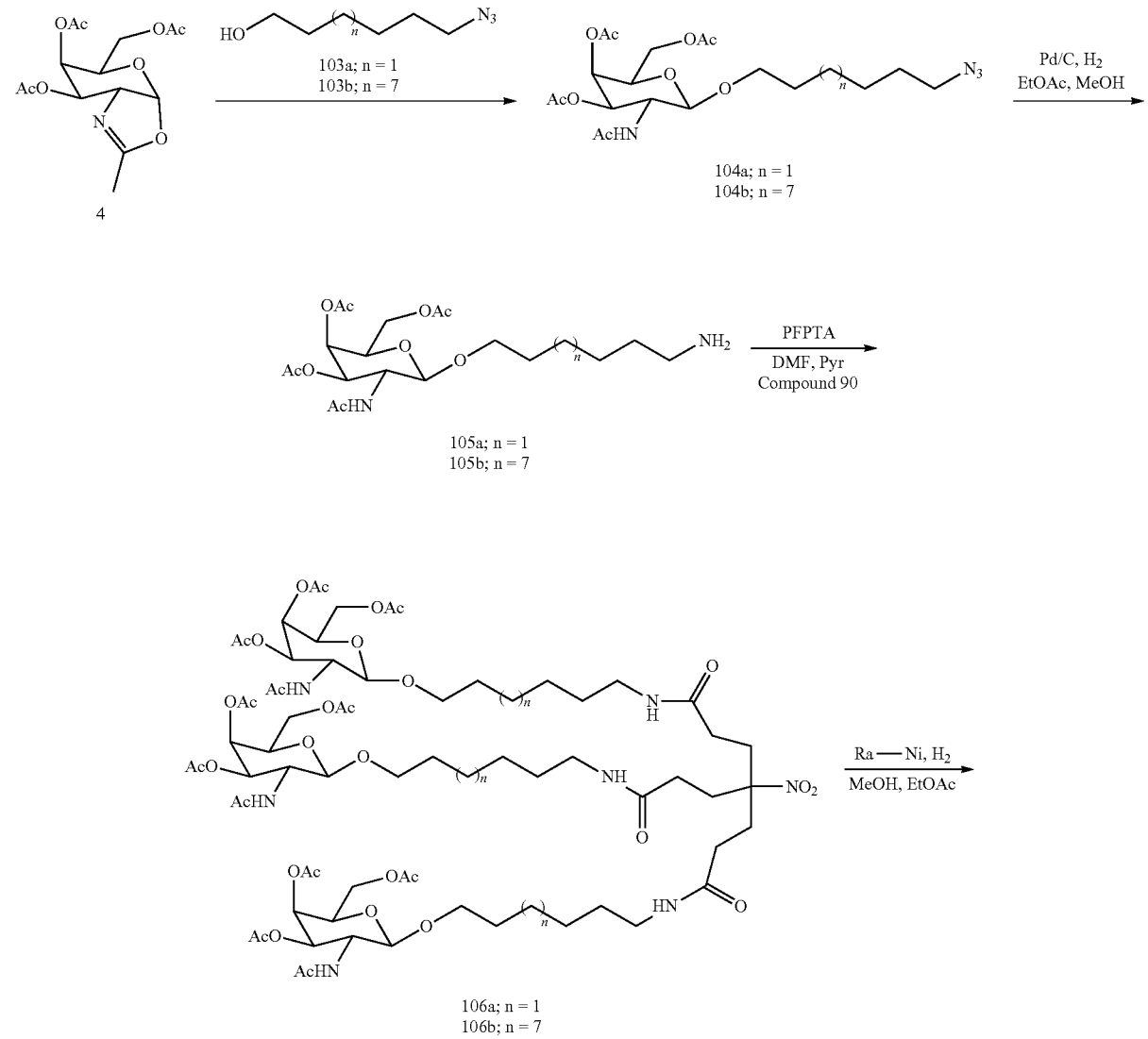

-continued
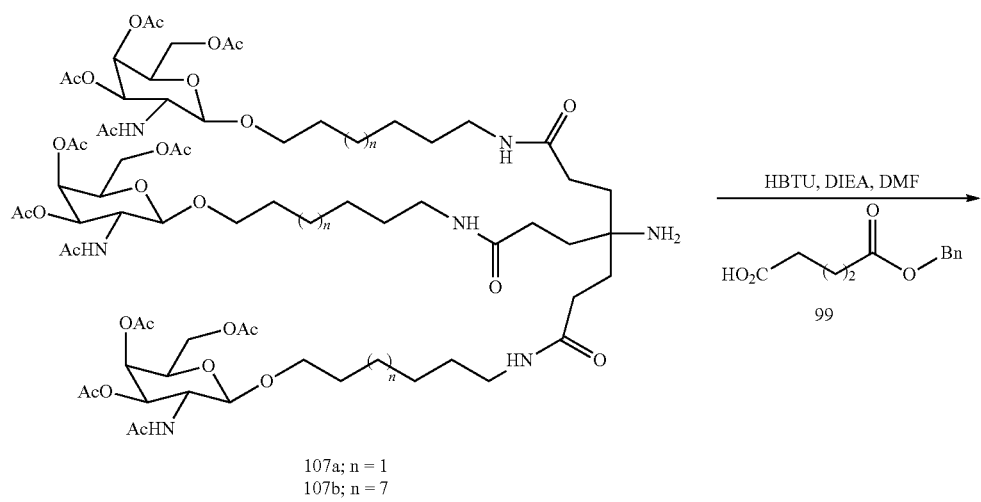
107a; n = 1
107b; n = 7
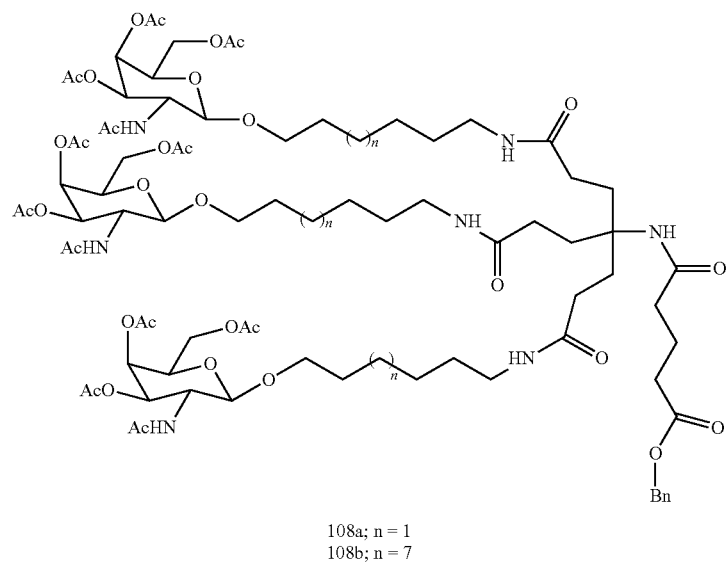
108a; n = 1
108b; n = 7
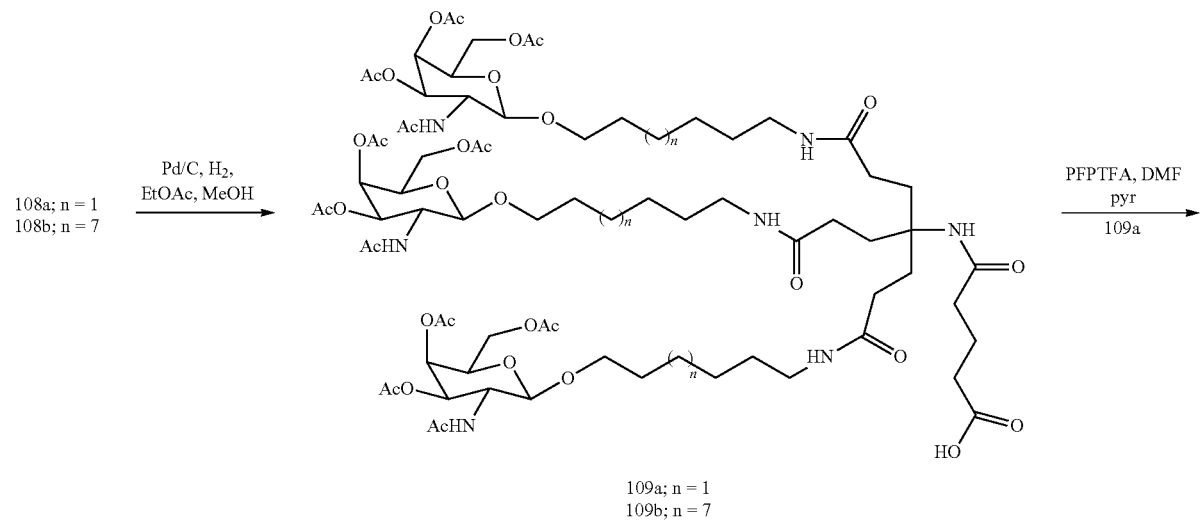
109a; n = 1
109b; n = 7

-continued

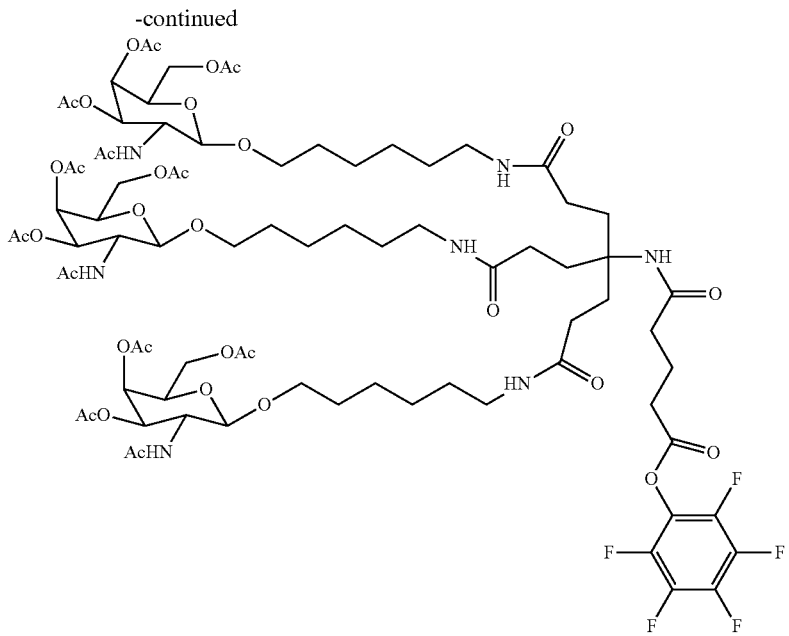

110a

Compound 4 (9.5 g, 28.8 mmoles) was treated with compound 103a or 103b (38 mmoles), individually, and TMSOTf (0.5 eq.) and molecular sieves in dichloromethane (200 mL), and stirred for 16 hours at room temperature. At that time, the organic layer was filtered thru celite, then washed with sodium bicarbonate, water and brine. The organic layer was then separated and dried over sodium sulfate, filtered and reduced under reduced pressure. The resultant oil was purified by silica gel chromatography (2%→10% methanadichloromethane) to give compounds 104a and 104b in >80% yield. LCMS and proton NMR was consistent with the structure.

Compounds 104a and 104b were treated to the same conditions as for compounds 100a-d (Example 47), to give compounds 105a and 105b in >90% yield. LCMS and proton NMR was consistent with the structure.

Compounds 105a and 105b were treated, individually, with compound 90 under the same conditions as for compounds 901a-d, to give compounds 106a (80%) and 106b (20%). LCMS and proton NMR was consistent with the structure.

Compounds 106a and 106b were treated to the same conditions as for compounds 96a-d (Example 47), to give 107a (60%) and 107b (20%). LCMS and proton NMR was consistent with the structure.

Compounds 107a and 107b were treated to the same conditions as for compounds 97a-d (Example 47), to give compounds 108a and 108b in 40-60% yield. LCMS and proton NMR was consistent with the structure.

Compounds 108a (60%) and 108b (40%) were treated to the same conditions as for compounds 100a-d (Example 47), to give compounds 109a and 109b in >80% yields. LCMS and proton NMR was consistent with the structure.

Compound 109a was treated to the same conditions as for compounds 101a-d (Example 47), to give Compound 110a in 30-60% yield. LCMS and proton NMR was consistent with the structure. Alternatively, Compound 110b can be prepared in a similar manner starting with Compound 109b.

Example 46

General Procedure for Conjugation with PFP Esters (Oligonucleotide 111); Preparation of ISIS 666881 (GalNAc$_3$-10)

A 5'-hexylamino modified oligonucleotide was synthesized and purified using standard solid-phase oligonucleotide procedures. The 5'-hexylamino modified oligonucleotide was dissolved in 0.1 M sodium tetraborate, pH 8.5 (200 µL) and 3 equivalents of a selected PFP esterified GalNAc$_3$ cluster dissolved in DMSO (50 µL) was added. If the PFP ester precipitated upon addition to the ASO solution DMSO was added until all PFP ester was in solution. The reaction was complete after about 16 h of mixing at room temperature. The resulting solution was diluted with water to 12 mL and then spun down at 3000 rpm in a spin filter with a mass cut off of 3000 Da. This process was repeated twice to remove small molecule impurities. The solution was then lyophilized to dryness and redissolved in concentrated aqueous ammonia and mixed at room temperature for 2.5 h followed by concentration in vacuo to remove most of the ammonia. The conjugated oligonucleotide was purified and desalted by RP-HPLC and lyophilized to provide the GalNAc$_3$ conjugated oligonucleotide.

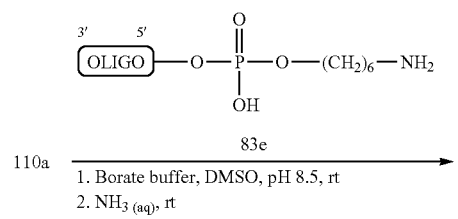

110a

1. Borate buffer, DMSO, pH 8.5, rt
2. NH$_3$ (aq), rt

-continued

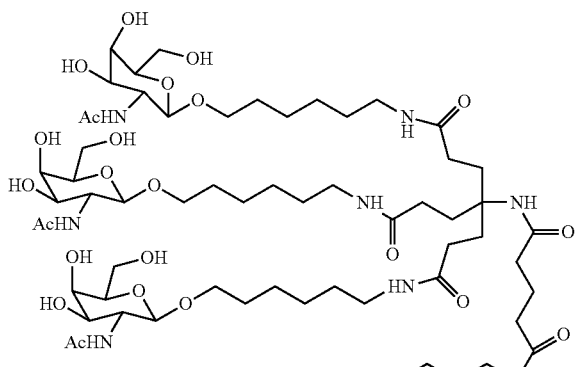

111

Oligonucleotide 111 is conjugated with GalNAc₃-10. The GalNAc₃ cluster portion of the conjugate group GalNAc₃-10 (GalNAc₃-10$_a$) can be combined with any cleavable moiety to provide a variety of conjugate groups. In certain embodiments, the cleavable moiety is —P(=O)(OH)-A$_d$-P(=O)(OH)— as shown in the oligonucleotide (ISIS 666881) synthesized with GalNAc₃-10 below. The structure of GalNAc₃-10 (GalNAc₃-10$_a$-CM-) is shown below:

(50 μL) was added. The PFP ester precipitated upon addition to the ASO solution requiring additional DMSO (600 μL) to fully dissolve the PFP ester. The reaction was complete after 16 h of mixing at room temperature. The solution was diluted with water to 12 mL total volume and spun down at 3000 rpm in a spin filter with a mass cut off of 3000 Da. This process was repeated twice to remove small molecule impurities. The solution was lyophilized to dryness and redissolved in concentrated aqueous ammonia with mixing at room temperature for 2.5 h followed by concentration in vacuo to remove most of the ammonia. The conjugated oligonucleotide was purified and desalted by RP-HPLC and lyophilized to give ISIS 666881 in 90% yield by weight (42 mg, 4.7 μmol).

| | GalNAc₃-10 conjugated oligonucleotide | | |
|---|---|---|---|
| ASO | Sequence (5' to 3') | 5' group | SEQ ID No. |
| ISIS 660254 | NH₂(CH₂)₆-$_o$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | Hexylamine | 109 |
| ISIS 666881 | GalNAc₃-10$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc₃-10 | 109 |

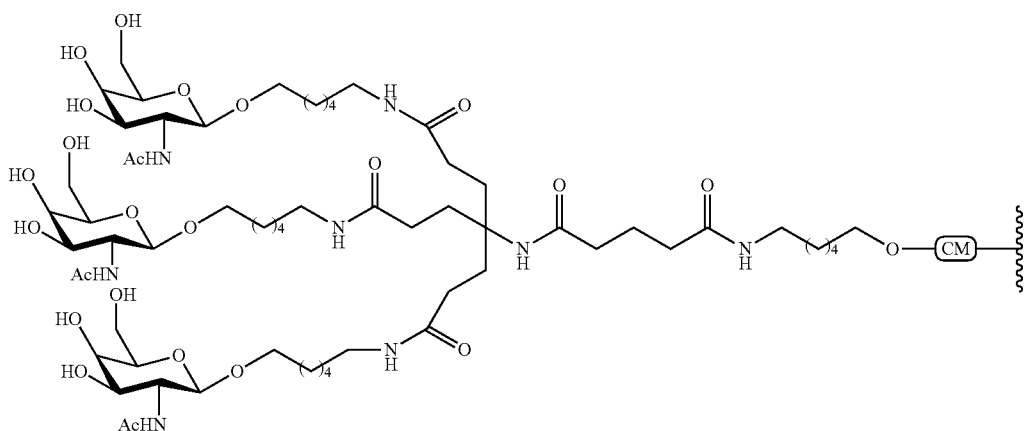

Following this general procedure ISIS 666881 was prepared. 5'-hexylamino modified oligonucleotide, ISIS 660254, was synthesized and purified using standard solid-phase oligonucleotide procedures. ISIS 660254 (40 mg, 5.2 μmol) was dissolved in 0.1 M sodium tetraborate, pH 8.5 (200 μL) and 3 equivalents PFP ester (Compound 110a) dissolved in DMSO Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

Example 47
Preparation of Oligonucleotide 102 Comprising GalNAc$_3$-8
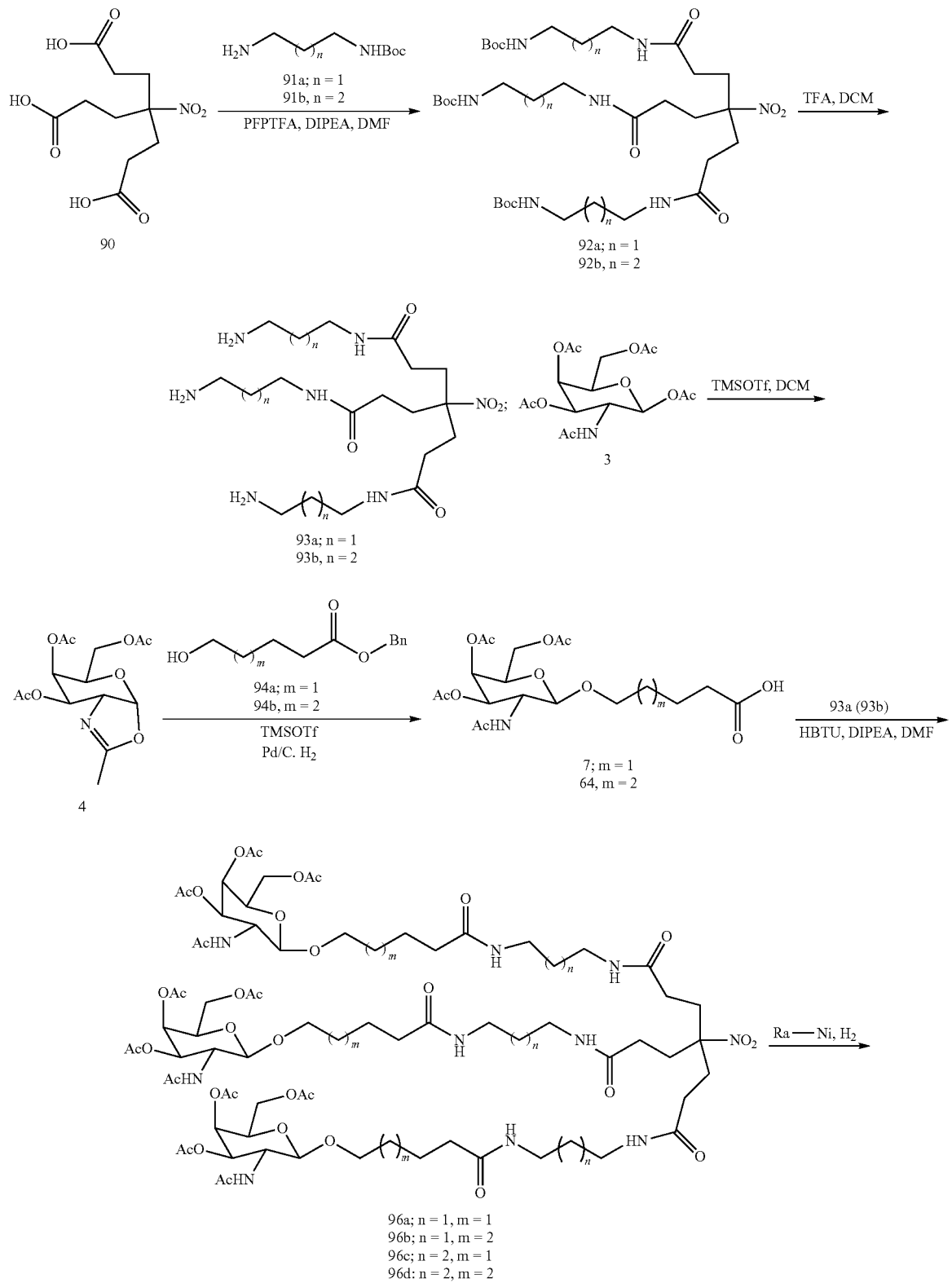

-continued
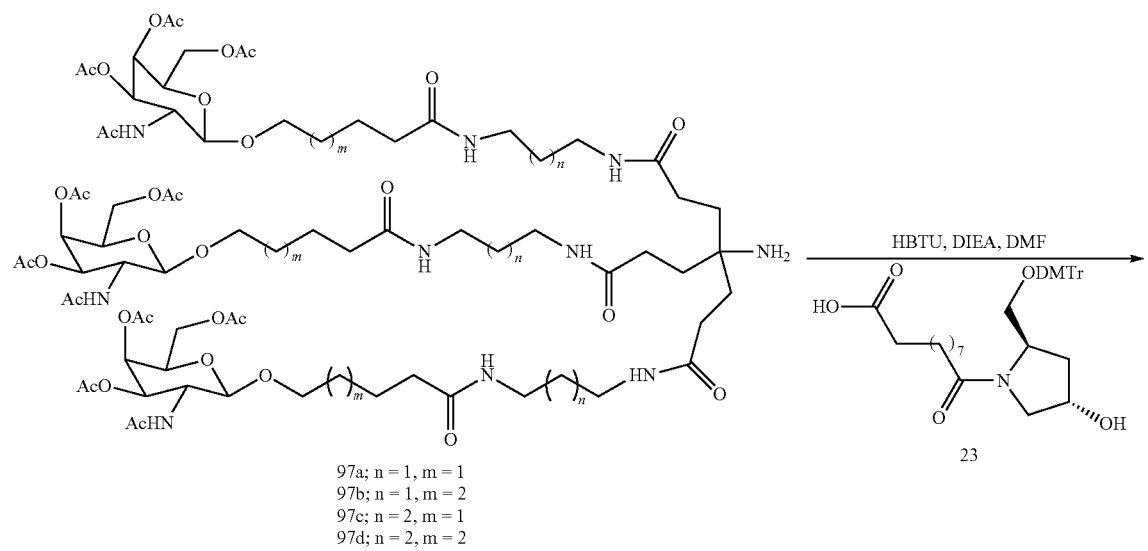
97a; n = 1, m = 1
97b; n = 1, m = 2
97c; n = 2, m = 1
97d; n = 2, m = 2
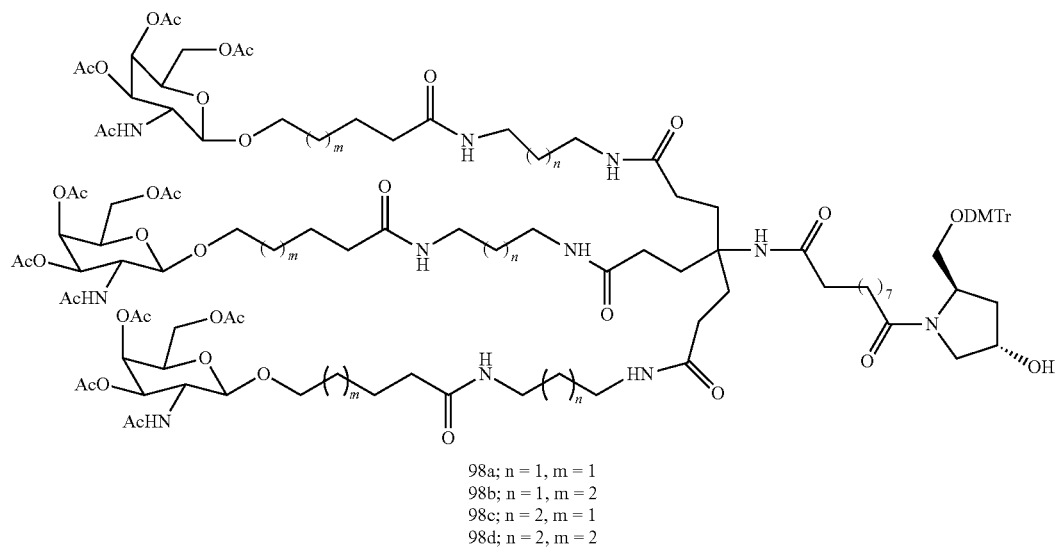
98a; n = 1, m = 1
98b; n = 1, m = 2
98c; n = 2, m = 1
98d; n = 2, m = 2
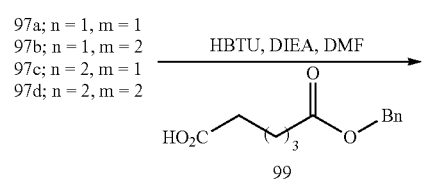

-continued
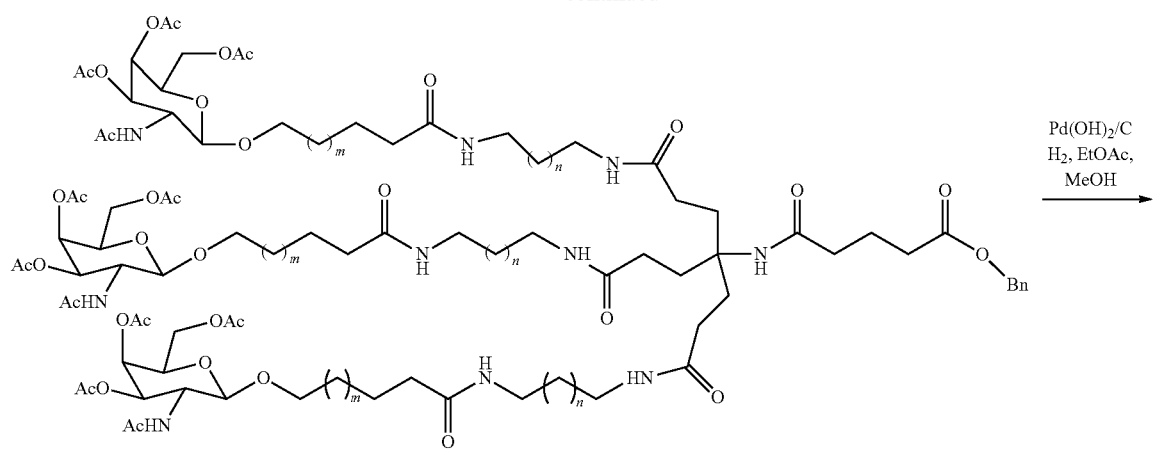
100a; n = 1, m = 1
100b; n = 1, m = 2
100c; n = 2, m = 1
100d; n = 2, m = 2
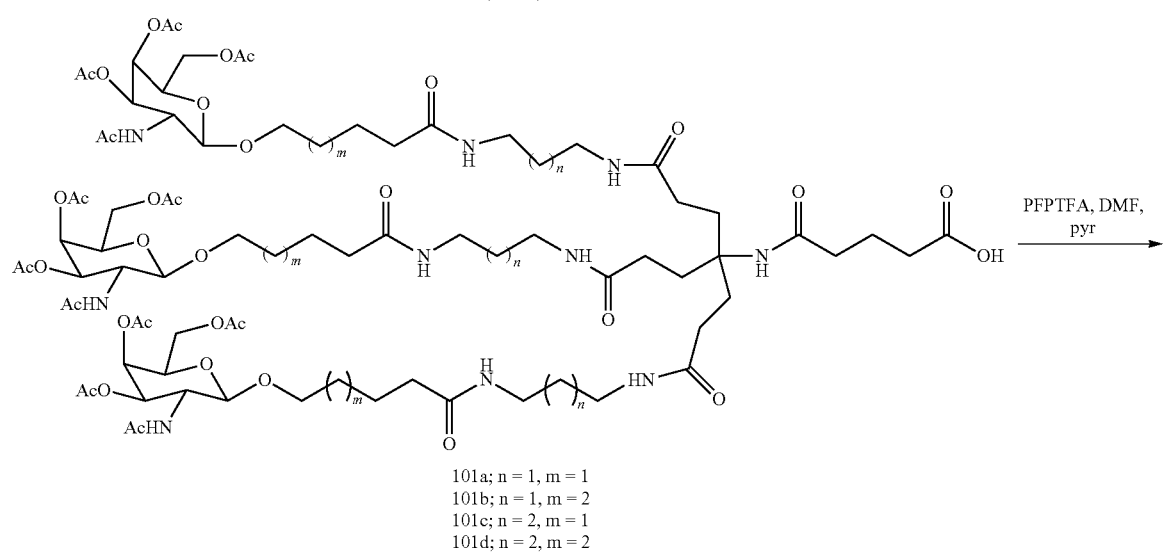
101a; n = 1, m = 1
101b; n = 1, m = 2
101c; n = 2, m = 1
101d; n = 2, m = 2
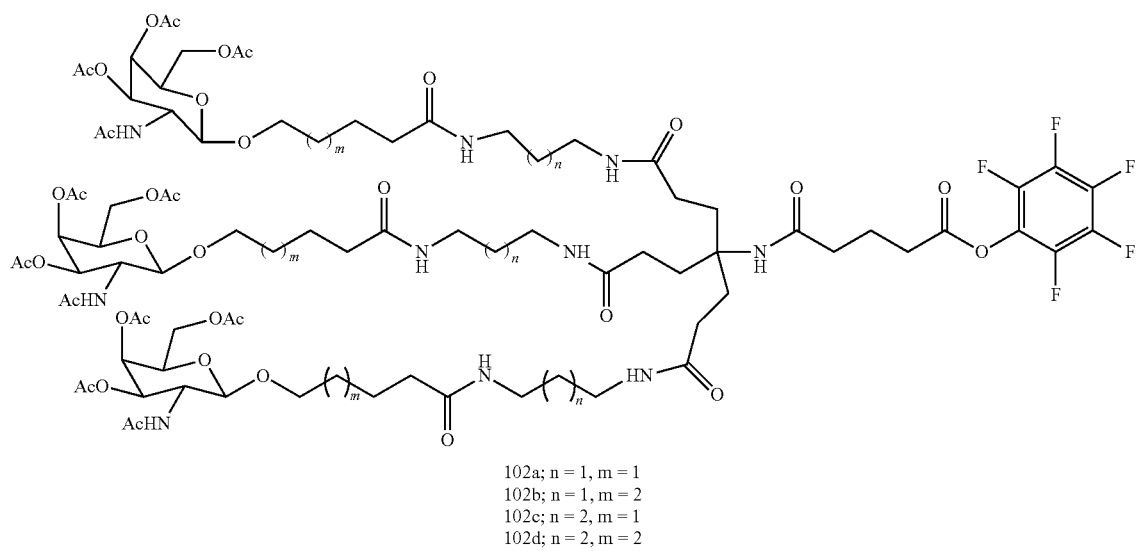
102a; n = 1, m = 1
102b; n = 1, m = 2
102c; n = 2, m = 1
102d; n = 2, m = 2

The triacid 90 (4 g, 14.43 mmol) was dissolved in DMF (120 mL) and N,N-Diisopropylethylamine (12.35 mL, 72 mmoles). Pentafluorophenyl trifluoroacetate (8.9 mL, 52 mmoles) was added dropwise, under argon, and the reaction was allowed to stir at room temperature for 30 minutes. Boc-diamine 91a or 91b (68.87 mmol) was added, along with N,N-Diisopropylethylamine (12.35 mL, 72 mmoles), and the reaction was allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%→10% methanadichloromethane) to give compounds 92a and 92b in an approximate 80% yield. LCMS and proton NMR were consistent with the structure.

Compound 92a or 92b (6.7 mmoles) was treated with 20 mL of dichloromethane and 20 mL of trifluoroacetic acid at room temperature for 16 hours. The resultant solution was evaporated and then dissolved in methanol and treated with DOWEX-OH resin for 30 minutes. The resultant solution was filtered and reduced to an oil under reduced pressure to give 85-90% yield of compounds 93a and 93b.

Compounds 7 or 64 (9.6 mmoles) were treated with HBTU (3.7 g, 9.6 mmoles) and N,N-Diisopropylethylamine (5 mL) in DMF (20 mL) for 15 minutes. To this was added either compounds 93a or 93b (3 mmoles), and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%→20% methanol/dichloromethane) to give compounds 96a-d in 20-40% yield. LCMS and proton NMR was consistent with the structure.

Compounds 96a-d (0.75 mmoles), individually, were hydrogenated over Raney Nickel for 3 hours in Ethanol (75 mL). At that time, the catalyst was removed by filtration thru celite, and the ethanol removed under reduced pressure to give compounds 97a-d in 80-90% yield. LCMS and proton NMR were consistent with the structure.

Compound 23 (0.32 g, 0.53 mmoles) was treated with HBTU (0.2 g, 0.53 mmoles) and N,N-Diisopropylethylamine (0.19 mL, 1.14 mmoles) in DMF (30 mL) for 15 minutes. To this was added compounds 97a-d (0.38 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%→20% methanol/dichloromethane) to give compounds 98a-d in 30-40% yield. LCMS and proton NMR was consistent with the structure.

Compound 99 (0.17 g, 0.76 mmoles) was treated with HBTU (0.29 g, 0.76 mmoles) and N,N-Diisopropylethylamine (0.35 mL, 2.0 mmoles) in DMF (50 mL) for 15 minutes. To this was added compounds 97a-d (0.51 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%→20% methanol/dichloromethane) to give compounds 100a-d in 40-60% yield. LCMS and proton NMR was consistent with the structure.

Compounds 100a-d (0.16 mmoles), individually, were hydrogenated over 10% Pd(OH)$_2$/C for 3 hours in methanol/ethyl acetate (1:1, 50 mL). At that time, the catalyst was removed by filtration thru celite, and the organics removed under reduced pressure to give compounds 101a-d in 80-90% yield. LCMS and proton NMR was consistent with the structure.

Compounds 101a-d (0.15 mmoles), individually, were dissolved in DMF (15 mL) and pyridine (0.016 mL, 0.2 mmoles). Pentafluorophenyl trifluoroacetate (0.034 mL, 0.2 mmoles) was added dropwise, under argon, and the reaction was allowed to stir at room temperature for 30 minutes. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%→5% methanadichloromethane) to give compounds 102a-d in an approximate 80% yield. LCMS and proton NMR were consistent with the structure.

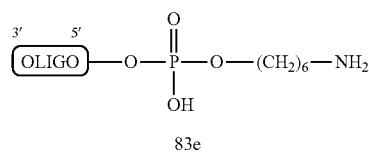

83e

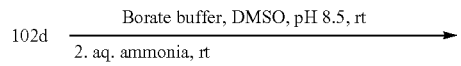

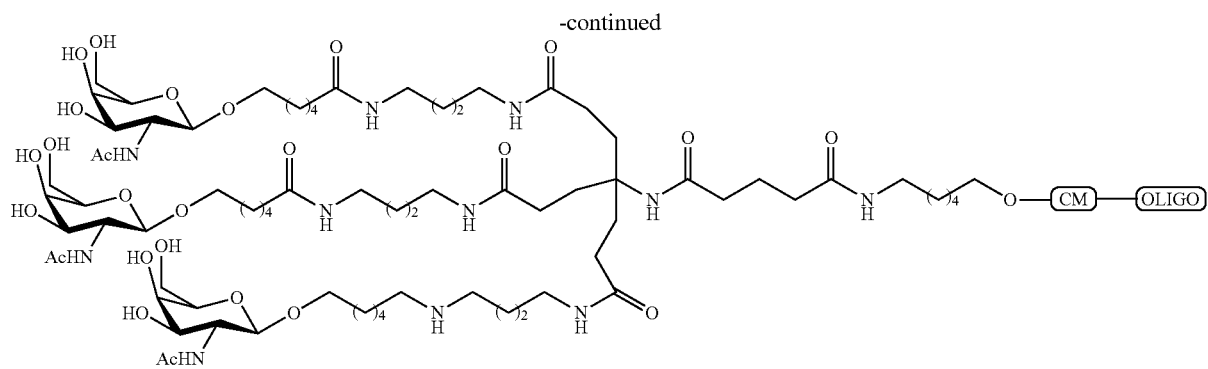

102

Oligomeric Compound 102, comprising a GalNAc$_3$-8 conjugate group, was prepared using the general procedures illustrated in Example 46. The GalNAc$_3$ cluster portion of the conjugate group GalNAc$_3$-8 (GalNAc$_3$-8$_a$) can be combined with any cleavable moiety to provide a variety of conjugate groups. In a preferred embodiment, the cleavable moiety is —P(=O)(OH)-A$_d$-P(=O)(OH)—.

The structure of GalNAc$_3$-8 (GalNAc$_3$-8$_a$-CM-) is shown below:

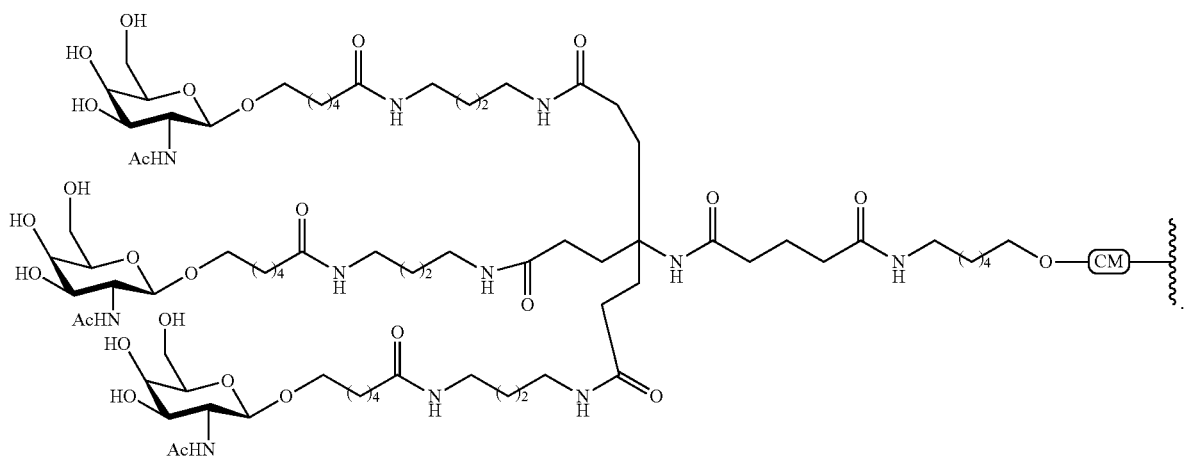

Example 48

Preparation of Oligonucleotide 119 Comprising GalNAc$_3$-7

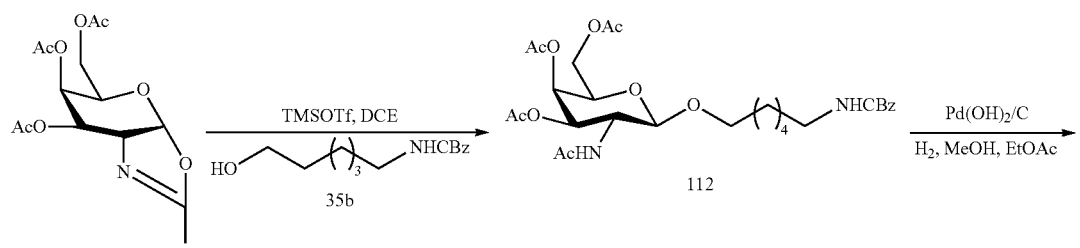

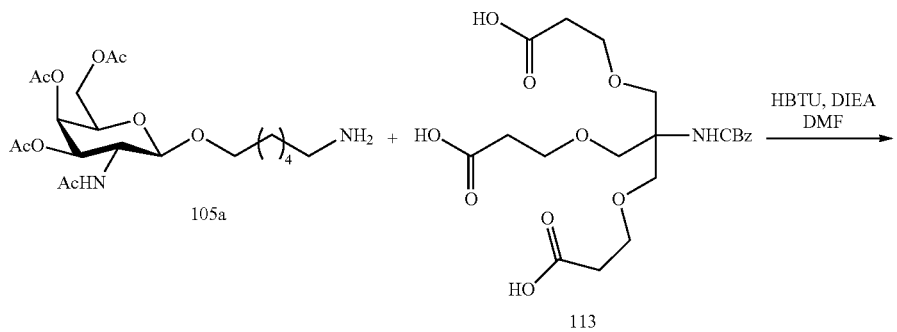
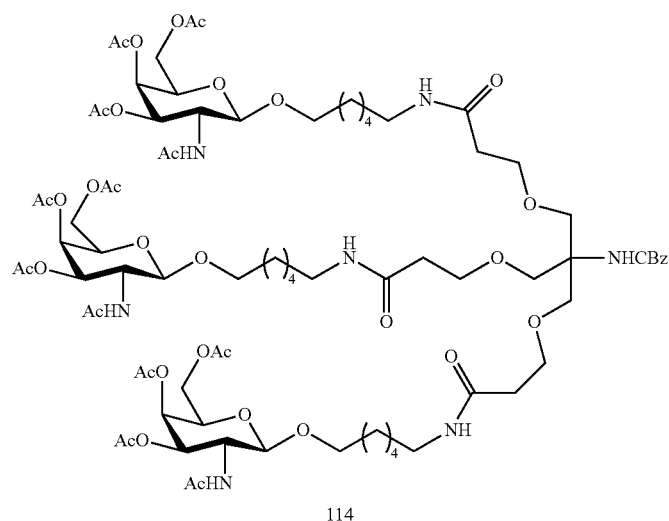
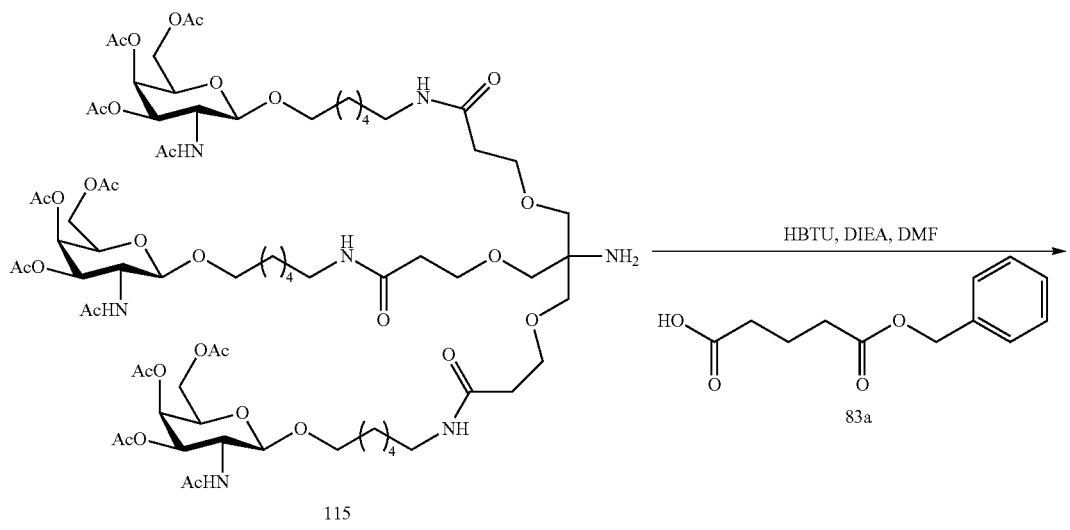

-continued

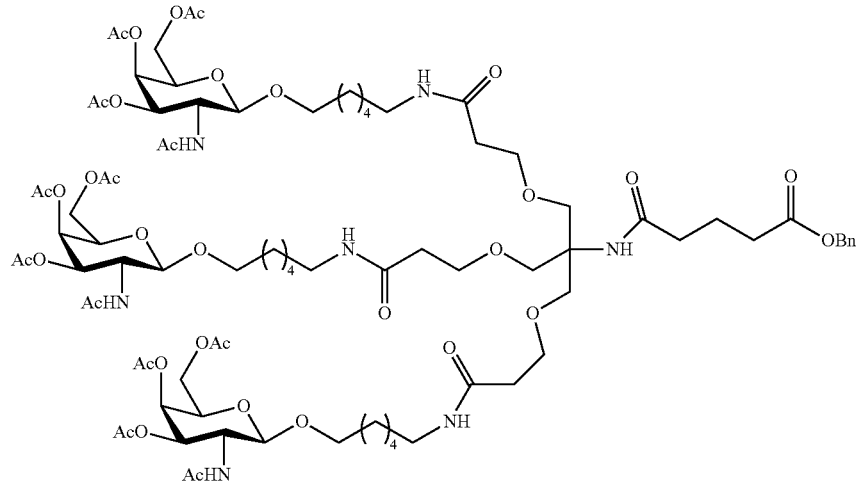

116

Compound 112 was synthesized following the procedure described in the literature (*J. Med. Chem.* 2004, 47, 5798-5808).

Compound 112 (5 g, 8.6 mmol) was dissolved in 1:1 methanol/ethyl acetate (22 mL/22 mL). Palladium hydroxide on carbon (0.5 g) was added. The reaction mixture was stirred at room temperature under hydrogen for 12 h. The reaction mixture was filtered through a pad of celite and washed the pad with 1:1 methanol/ethyl acetate. The filtrate and the washings were combined and concentrated to dryness to yield Compound 105a (quantitative). The structure was confirmed by LCMS.

Compound 113 (1.25 g, 2.7 mmol), HBTU (3.2 g, 8.4 mmol) and DIEA (2.8 mL, 16.2 mmol) were dissolved in anhydrous DMF (17 mL) and the reaction mixture was stirred at room temperature for 5 min. To this a solution of Compound 105a (3.77 g, 8.4 mmol) in anhydrous DMF (20 mL) was added. The reaction was stirred at room temperature for 6 h. Solvent was removed under reduced pressure to get an oil. The residue was dissolved in CH$_2$Cl$_2$ (100 mL) and washed with aqueous saturated NaHCO$_3$ solution (100 mL) and brine (100 mL). The organic phase was separated, dried (Na$_2$SO$_4$), filtered and evaporated. The residue was purified by silica gel column chromatography and eluted with 10 to 20% MeOH in dichloromethane to yield Compound 114 (1.45 g, 30%). The structure was confirmed by LCMS and $^1$H NMR analysis.

Compound 114 (1.43 g, 0.8 mmol) was dissolved in 1:1 methanol/ethyl acetate (4 mL/4 mL). Palladium on carbon (wet, 0.14 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield Compound 115 (quantitative). The structure was confirmed by LCMS and $^1$H NMR analysis.

Compound 83a (0.17 g, 0.75 mmol), HBTU (0.31 g, 0.83 mmol) and DIEA (0.26 mL, 1.5 mmol) were dissolved in anhydrous DMF (5 mL) and the reaction mixture was stirred at room temperature for 5 min. To this a solution of Compound 115 (1.22 g, 0.75 mmol) in anhydrous DMF was added and the reaction was stirred at room temperature for 6 h. The solvent was removed under reduced pressure and the residue was dissolved in CH$_2$Cl$_2$. The organic layer was washed aqueous saturated NaHCO$_3$ solution and brine and dried over anhydrous Na$_2$SO$_4$ and filtered. The organic layer was concentrated to dryness and the residue obtained was purified by silica gel column chromatography and eluted with 3 to 15% MeOH in dichloromethane to yield Compound 116 (0.84 g, 61%). The structure was confirmed by LC MS and $^1$H NMR analysis.

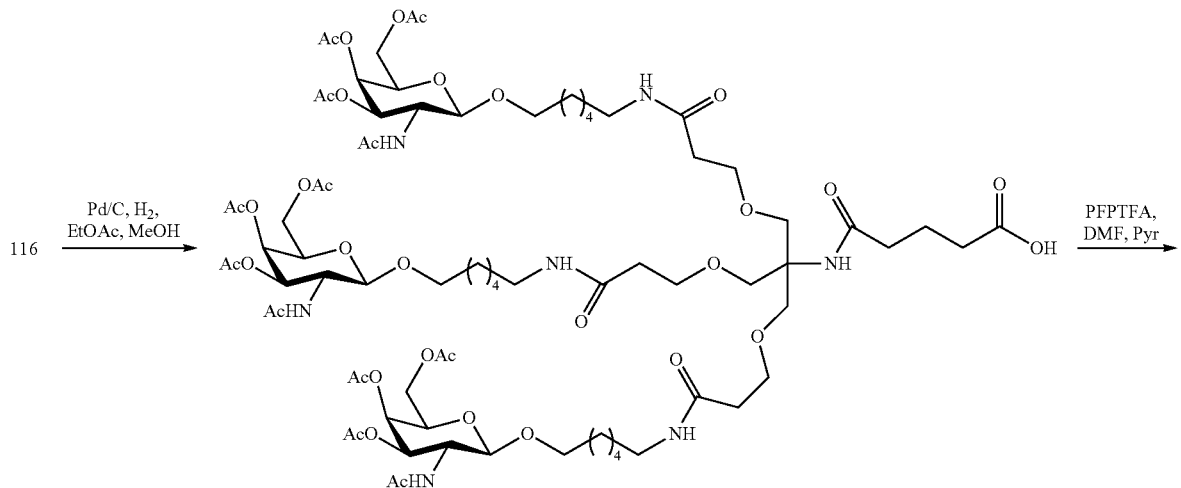

117

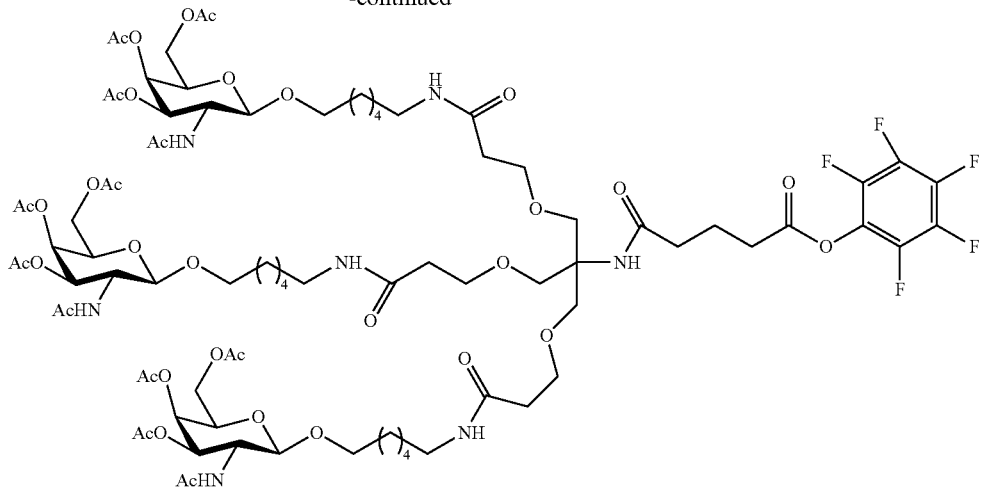

118

Compound 116 (0.74 g, 0.4 mmol) was dissolved in 1:1 methanol/ethyl acetate (5 mL/5 mL). Palladium on carbon (wet, 0.074 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield compound 117 (0.73 g, 98%). The structure was confirmed by LCMS and $^1$H NMR analysis.

Compound 117 (0.63 g, 0.36 mmol) was dissolved in anhydrous DMF (3 mL). To this solution N,N-Diisopropylethylamine (70 µL, 0.4 mmol) and pentafluorophenyl trifluoroacetate (72 µL, 0.42 mmol) were added. The reaction mixture was stirred at room temperature for 12 h and poured into a aqueous saturated NaHCO$_3$ solution. The mixture was extracted with dichloromethane, washed with brine and dried over anhydrous Na$_2$SO$_4$. The dichloromethane solution was concentrated to dryness and purified with silica gel column chromatography and eluted with 5 to 10% MeOH in dichloromethane to yield compound 118 (0.51 g, 79%). The structure was confirmed by LCMS and $^1$H and $^1$H and $^{19}$F NMR.

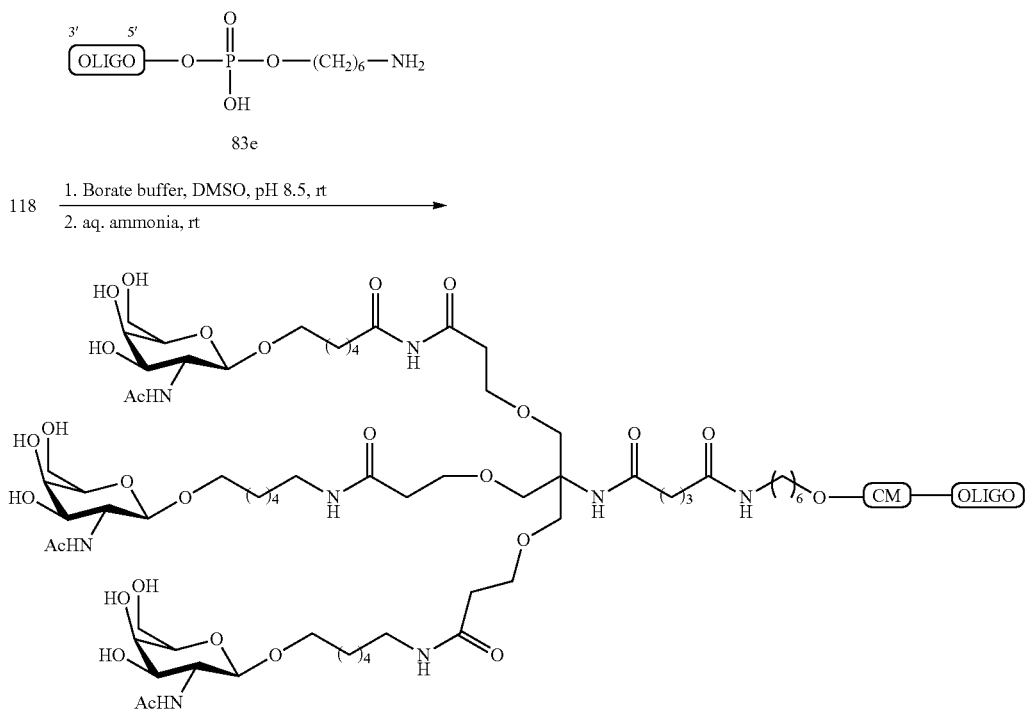

119

Oligomeric Compound 119, comprising a GalNAc$_3$-7 conjugate group, was prepared using the general procedures illustrated in Example 46. The GalNAc$_3$ cluster portion of the conjugate group GalNAc$_3$-7 (GalNAc$_3$-7$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-7 (GalNAc$_3$-7$_a$-CM-) is shown below:

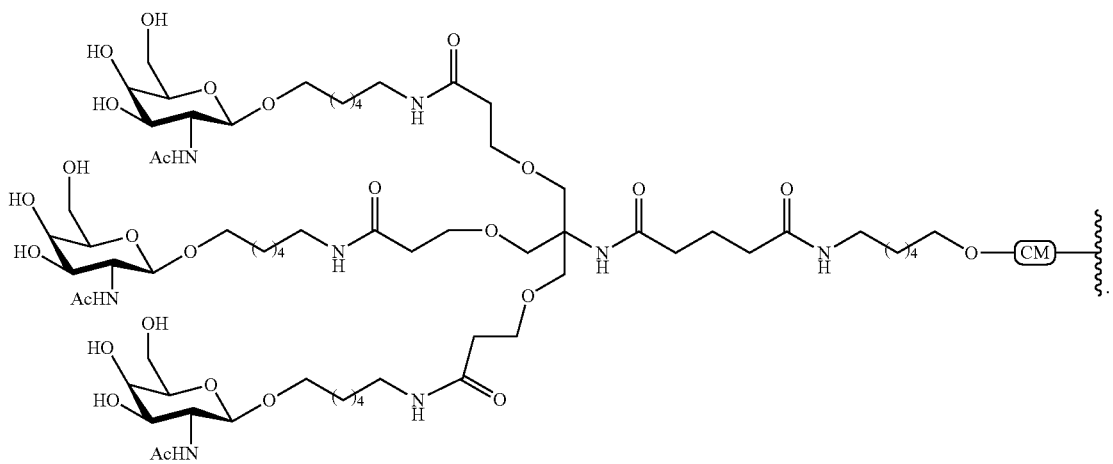

Example 49

Preparation of Oligonucleotide 132 Comprising GalNAc$_3$-5

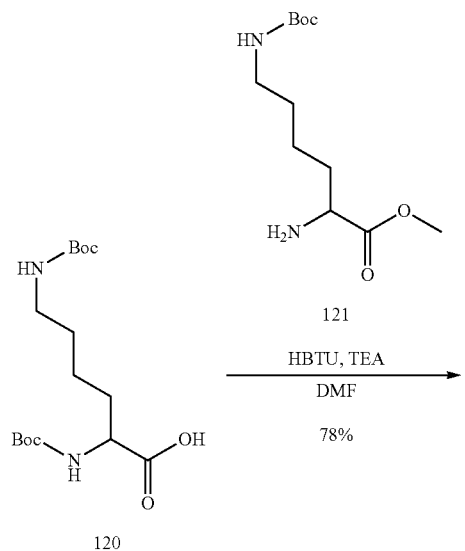

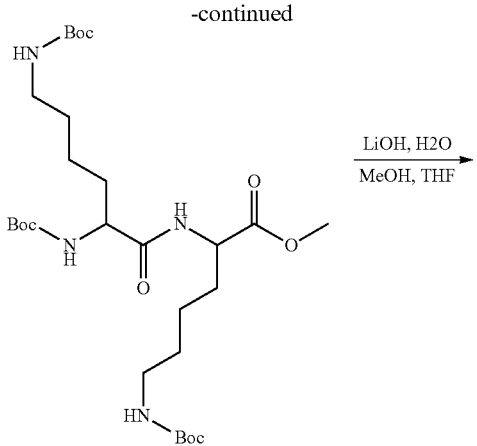

Compound 120 (14.01 g, 40 mmol) and HBTU (14.06 g, 37 mmol) were dissolved in anhydrous DMF (80 mL). Triethylamine (11.2 mL, 80.35 mmol) was added and stirred for 5 min. The reaction mixture was cooled in an ice bath and a solution of compound 121 (10 g, mmol) in anhydrous DMF (20 mL) was added. Additional triethylamine (4.5 mL, 32.28 mmol) was added and the reaction mixture was stirred for 18 h under an argon atmosphere. The reaction was monitored by TLC (ethyl acetate:hexane; 1:1; Rf=0.47). The solvent was removed under reduced pressure. The residue was taken up in EtOAc (300 mL) and washed with 1M NaHSO$_4$ (3×150 mL), aqueous saturated NaHCO$_3$ solution (3×150 mL) and brine (2×100 mL). Organic layer was dried with Na$_2$SO$_4$. Drying agent was removed by filtration and organic layer was concentrated by rotary evaporation. Crude mixture was purified by silica gel column chromatography and eluted by using 35-50% EtOAc in hexane to yield a compound 122 (15.50 g, 78.13%). The structure was confirmed by LCMS and $^1$H NMR analysis. Mass m/z 589.3 [M+H]$^+$.

A solution of LiOH (92.15 mmol) in water (20 mL) and THF (10 mL) was added to a cooled solution of Compound 122 (7.75 g, 13.16 mmol) dissolved in methanol (15 mL). The reaction mixture was stirred at room temperature for 45 min and monitored by TLC (EtOAc:hexane; 1:1). The reaction mixture was concentrated to half the volume under reduced pressure. The remaining solution was cooled an ice bath and neutralized by adding concentrated HCl. The reaction mixture was diluted, extracted with EtOAc (120 mL) and washed with brine (100 mL). An emulsion formed and cleared upon standing overnight. The organic layer was separated dried (Na$_2$SO$_4$), filtered and evaporated to yield Compound 123 (8.42 g). Residual salt is the likely cause of excess mass. LCMS is consistent with structure. Product was used without any further purification. M.W. cal: 574.36; M.W. fd: 575.3 [M+H]$^+$.

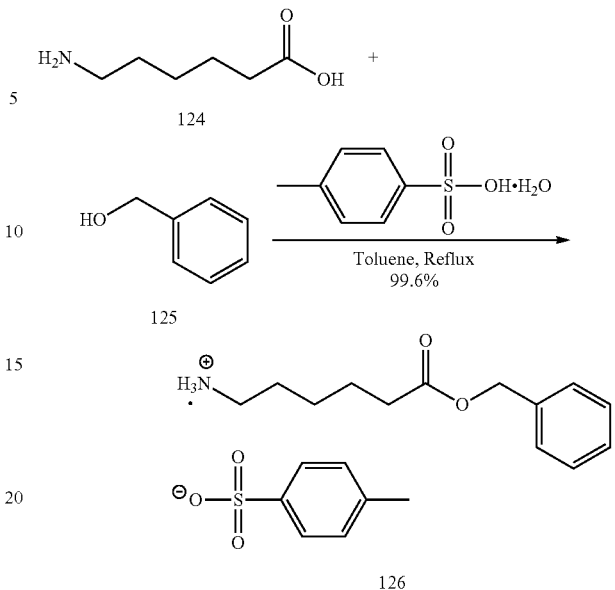

Compound 126 was synthesized following the procedure described in the literature (*J. Am. Chem. Soc.* 2011, 133, 958-963).

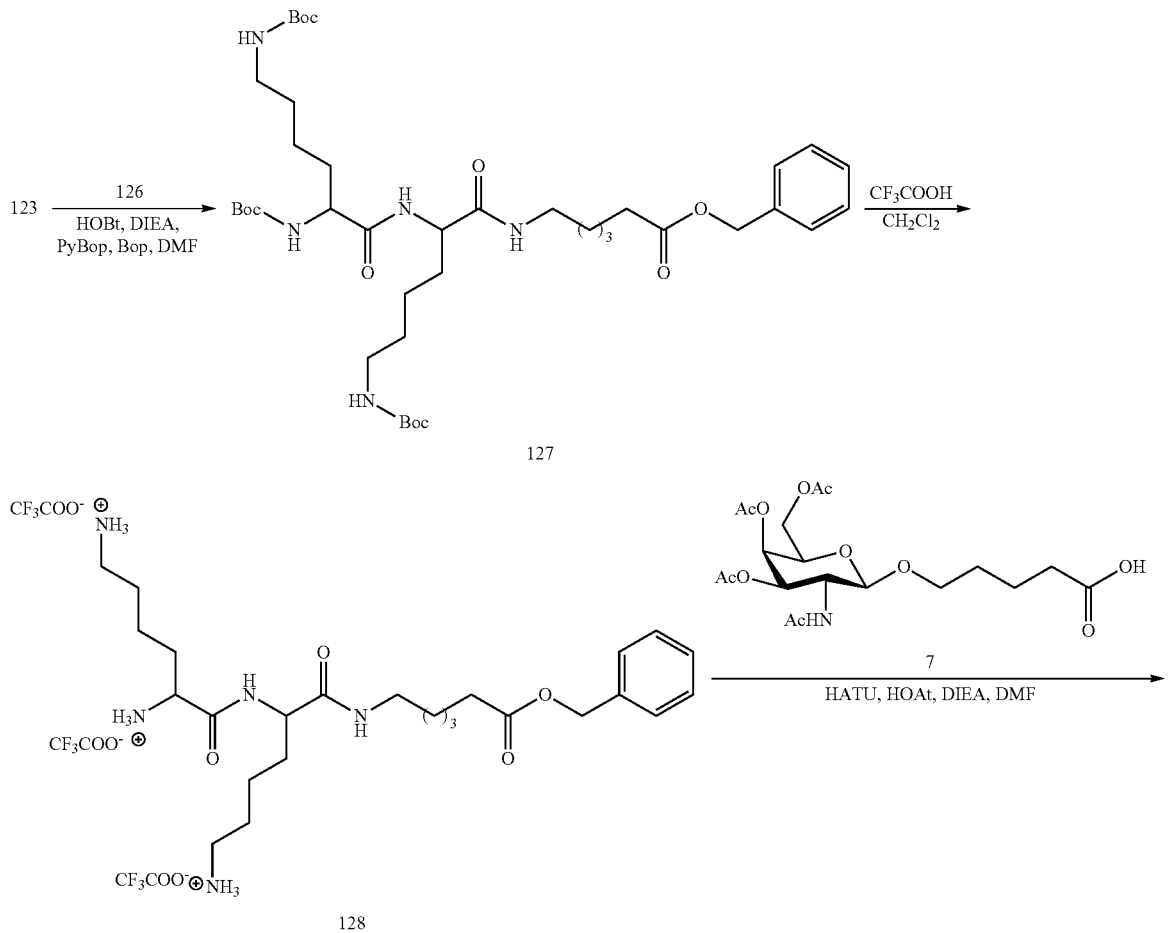

-continued
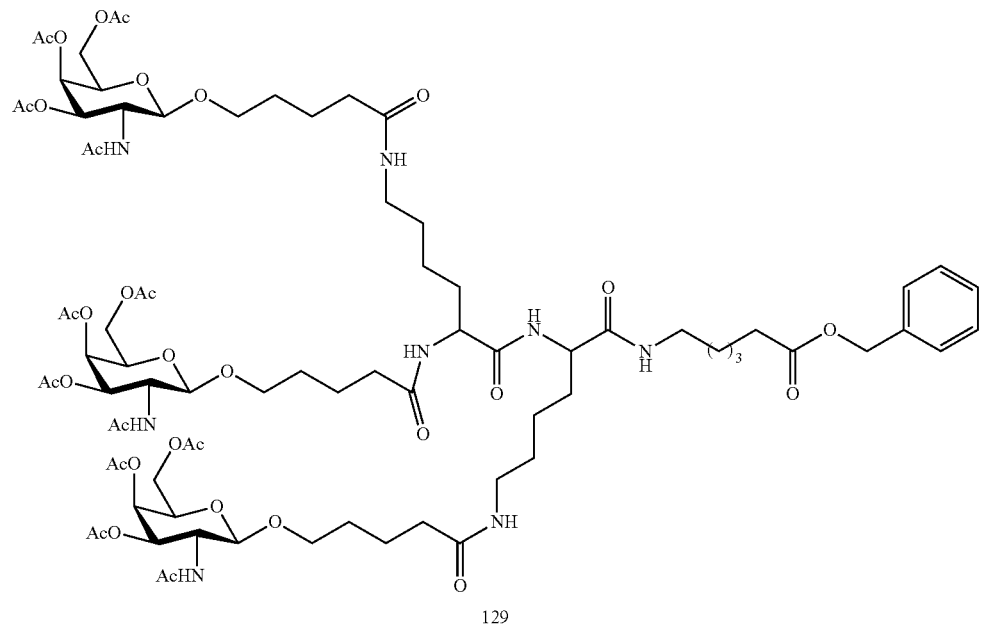
129
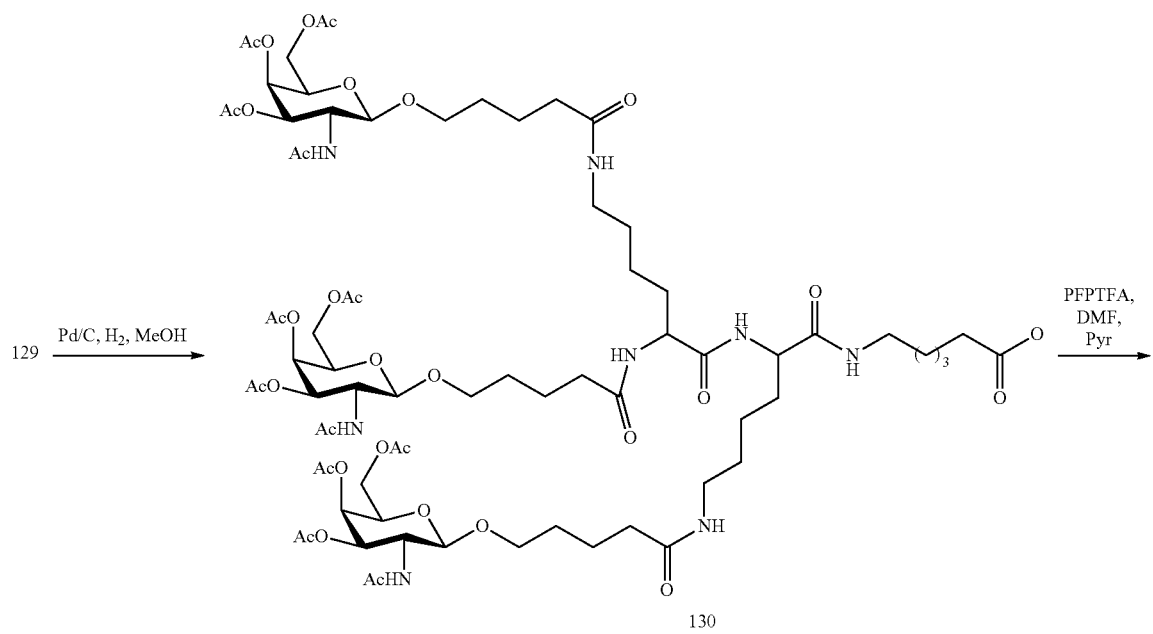

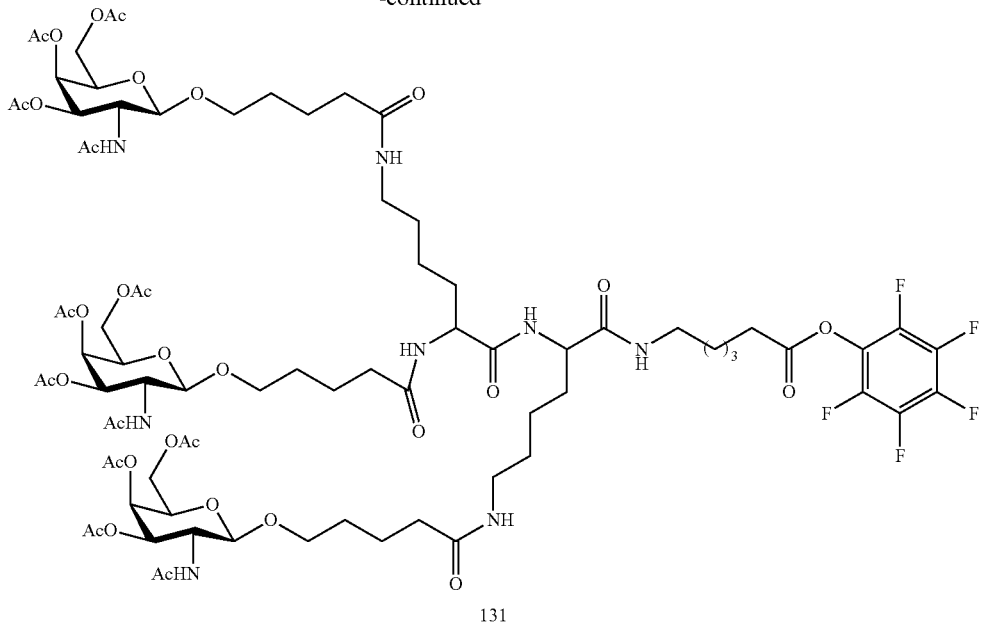

131

Compound 123 (7.419 g, 12.91 mmol), HOBt (3.49 g, 25.82 mmol) and compound 126 (6.33 g, 16.14 mmol) were dissolved in and DMF (40 mL) and the resulting reaction mixture was cooled in an ice bath. To this N,N-Diisopropylethylamine (4.42 mL, 25.82 mmol), PyBop (8.7 g, 16.7 mmol) followed by Bop coupling reagent (1.17 g, 2.66 mmol) were added under an argon atmosphere. The ice bath was removed and the solution was allowed to warm to room temperature. The reaction was completed after 1 h as determined by TLC (DCM:MeOH:AA; 89:10:1). The reaction mixture was concentrated under reduced pressure. The residue was dissolved in EtOAc (200 mL) and washed with 1 M NaHSO$_4$ (3×100 mL), aqueous saturated NaHCO$_3$ (3×100 mL) and brine (2×100 mL). The organic phase separated dried (Na$_2$SO$_4$), filtered and concentrated. The residue was purified by silica gel column chromatography with a gradient of 50% hexanes/EtOAC to 100% EtOAc to yield Compound 127 (9.4 g) as a white foam. LCMS and $^1$H NMR were consistent with structure. Mass m/z 778.4 [M+H]$^+$.

Trifluoroacetic acid (12 mL) was added to a solution of compound 127 (1.57 g, 2.02 mmol) in dichloromethane (12 mL) and stirred at room temperature for 1 h. The reaction mixture was co-evaporated with toluene (30 mL) under reduced pressure to dryness. The residue obtained was co-evaporated twice with acetonitrile (30 mL) and toluene (40 mL) to yield Compound 128 (1.67 g) as trifluoro acetate salt and used for next step without further purification. LCMS and $^1$H NMR were consistent with structure. Mass m/z 478.2 [M+H]$^+$.

Compound 7 (0.43 g, 0.963 mmol), HATU (0.35 g, 0.91 mmol), and HOAt (0.035 g, 0.26 mmol) were combined together and dried for 4 h over P$_2$O$_5$ under reduced pressure in a round bottom flask and then dissolved in anhydrous DMF (1 mL) and stirred for 5 min. To this a solution of compound 128 (0.20 g, 0.26 mmol) in anhydrous DMF (0.2 mL) and N,N-Diisopropylethylamine (0.2 mL) was added. The reaction mixture was stirred at room temperature under an argon atmosphere. The reaction was complete after 30 min as determined by LCMS and TLC (7% MeOH/DCM). The reaction mixture was concentrated under reduced pressure. The residue was dissolved in DCM (30 mL) and washed with 1 M NaHSO$_4$ (3×20 mL), aqueous saturated NaHCO$_3$ (3×20 mL) and brine (3×20 mL). The organic phase was separated, dried over Na$_2$SO$_4$, filtered and concentrated. The residue was purified by silica gel column chromatography using 5-15% MeOH in dichloromethane to yield Compound 129 (96.6 mg). LC MS and $^1$H NMR are consistent with structure. Mass m/z 883.4 [M+2H]$^+$.

Compound 129 (0.09 g, 0.051 mmol) was dissolved in methanol (5 mL) in 20 mL scintillation vial. To this was added a small amount of 10% Pd/C (0.015 mg) and the reaction vessel was flushed with H$_2$ gas. The reaction mixture was stirred at room temperature under H$_2$ atmosphere for 18 h. The reaction mixture was filtered through a pad of Celite and the Celite pad was washed with methanol. The filtrate washings were pooled together and concentrated under reduced pressure to yield Compound 130 (0.08 g). LCMS and $^1$H NMR were consistent with structure. The product was used without further purification. Mass m/z 838.3 [M+2H]$^+$.

To a 10 mL pointed round bottom flask were added compound 130 (75.8 mg, 0.046 mmol), 0.37 M pyridine/DMF (200 µL) and a stir bar. To this solution was added 0.7 M pentafluorophenyl trifluoroacetate/DMF (100 µL) drop wise with stirring. The reaction was completed after 1 h as determined by LC MS. The solvent was removed under reduced pressure and the residue was dissolved in CHCl$_3$ (~10 mL). The organic layer was partitioned against NaHSO$_4$ (1 M, 10 mL), aqueous saturated NaHCO$_3$ (10 mL) and brine (10 mL) three times each. The organic phase separated and dried over Na$_2$SO$_4$, filtered and concentrated to yield Compound 131 (77.7 mg). LCMS is consistent with structure. Used without further purification. Mass m/z 921.3 [M+2H]$^+$.

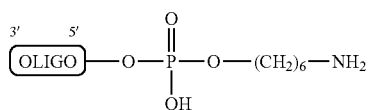

83e

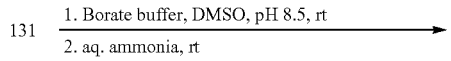

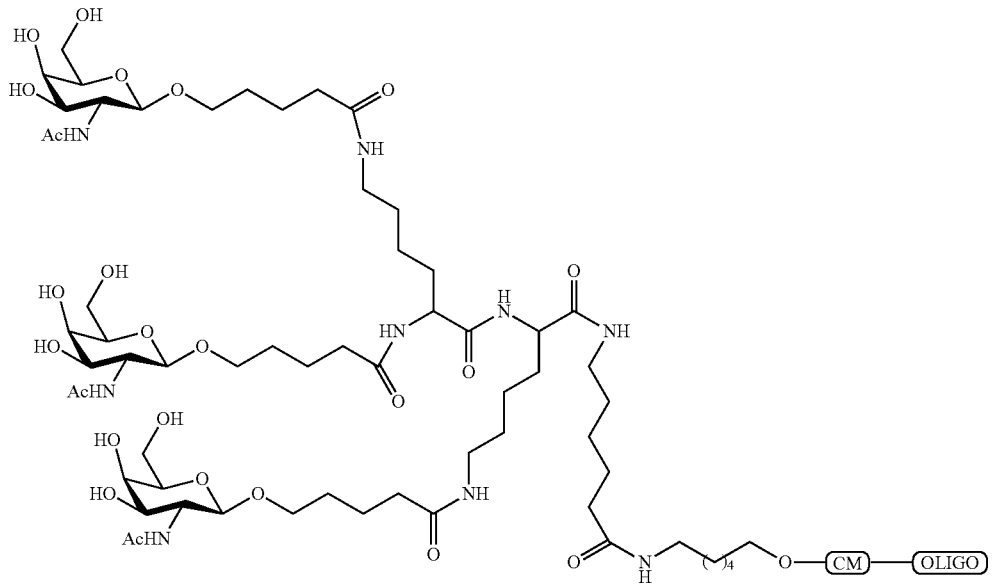

132

Oligomeric Compound 132, comprising a GalNAc$_3$-5 conjugate group, was prepared using the general procedures illustrated in Example 46. The GalNAc$_3$ cluster portion of the conjugate group GalNAc$_3$-(GalNAc$_3$-5$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-5 (GalNAc$_3$-5$_a$-CM-) is shown below:

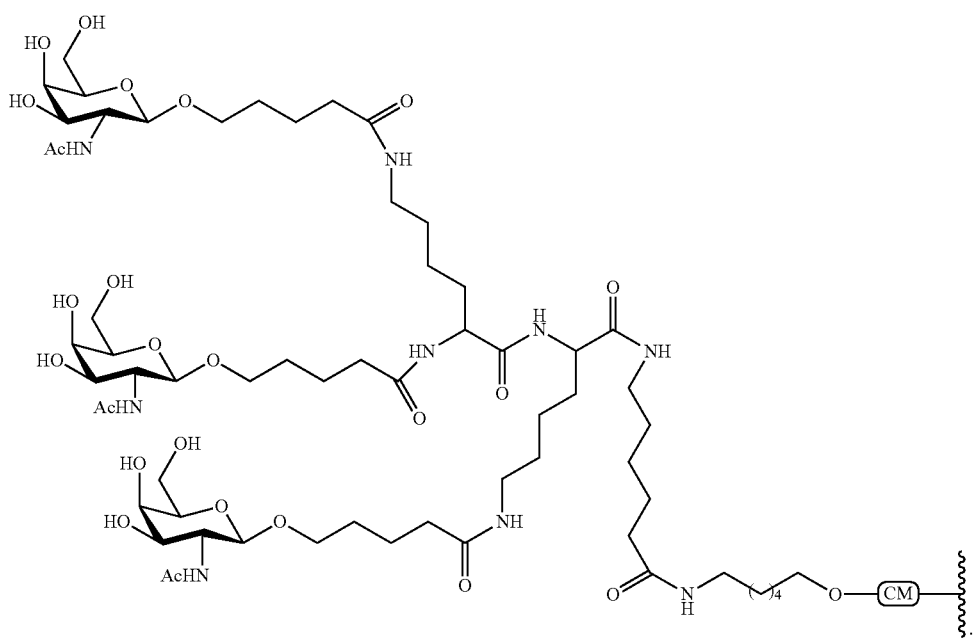

Example 50
Preparation of Oligonucleotide 144 Comprising GalNAc$_4$-11
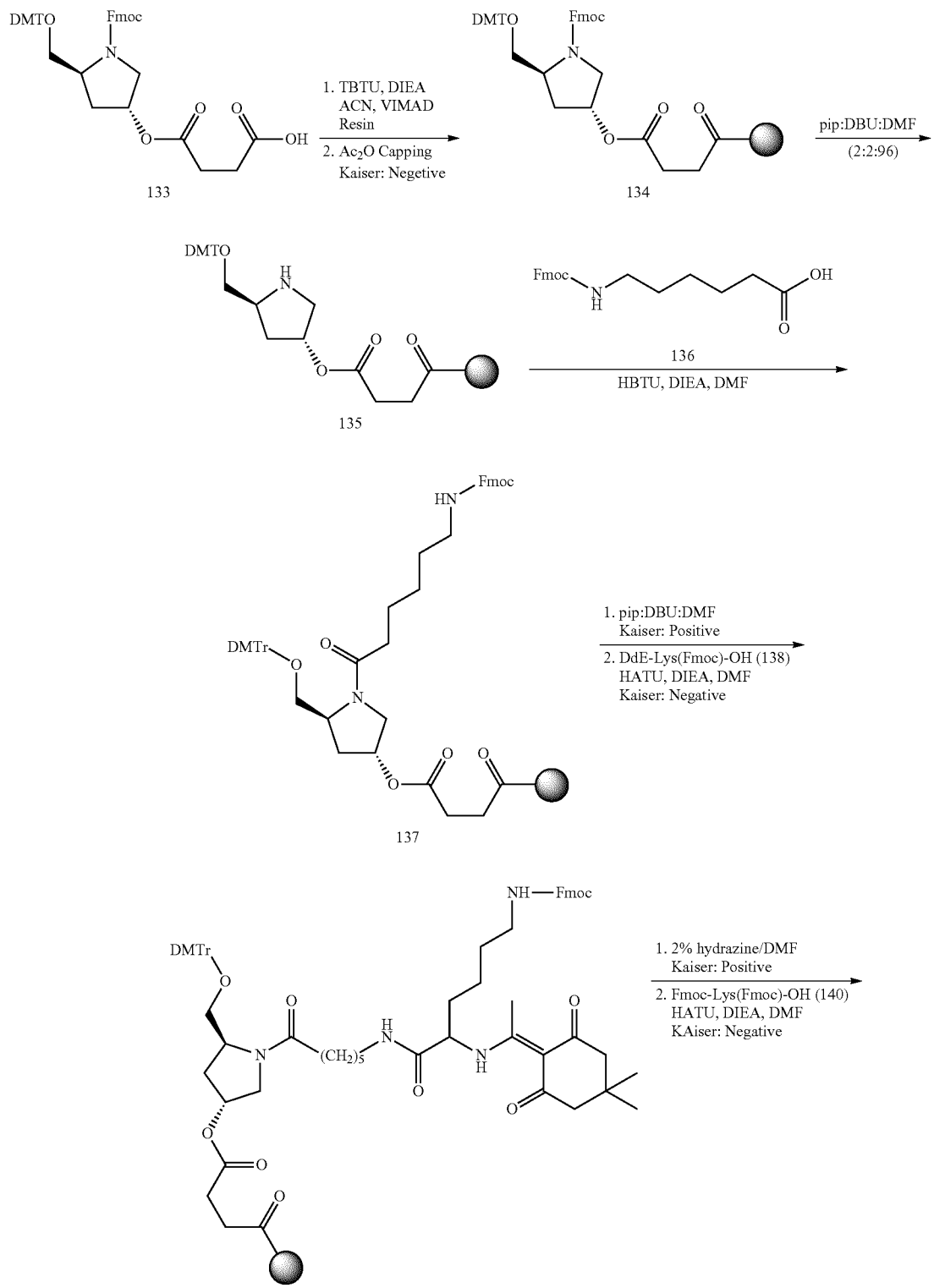

-continued

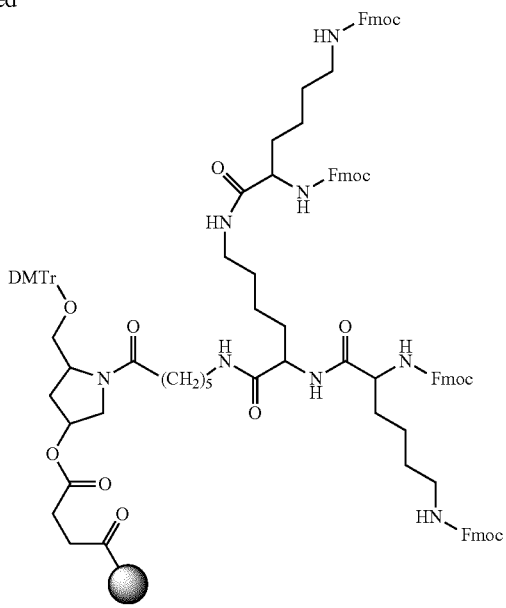

141

141 →
1. pip:DBU:DMF
   Kaiser: Positive
2. 7, HATU, DIEA, DMF
   Kaiser: Negative

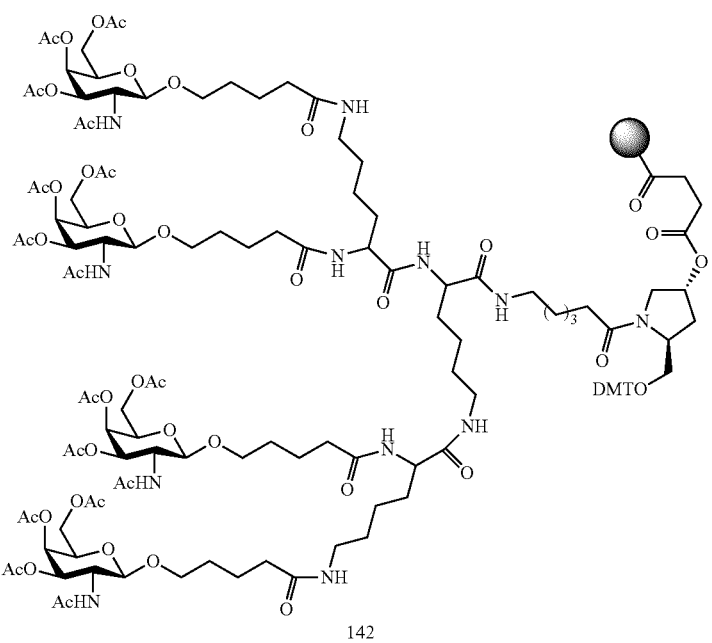

142

Synthesis of Compound 134. To a Merrifield flask was added aminomethyl VIMAD resin (2.5 g, 450 μmol/g) that was washed with acetonitrile, dimethylformamide, dichloromethane and acetonitrile. The resin was swelled in acetonitrile (4 mL). Compound 133 was pre-activated in a 100 mL round bottom flask by adding 20 (1.0 mmol, 0.747 g), TBTU (1.0 mmol, 0.321 g), acetonitrile (5 mL) and DIEA (3.0 mmol, 0.5 mL). This solution was allowed to stir for 5 min and was then added to the Merrifield flask with shaking. The suspension was allowed to shake for 3 h. The reaction mixture was drained and the resin was washed with acetonitrile, DMF and DCM. New resin loading was quantitated by measuring the absorbance of the DMT cation at 500 nm (extinction coefficient=76000) in DCM and determined to be 238 μmol/g. The resin was capped by suspending in an acetic anhydride solution for ten minutes three times.

The solid support bound compound 141 was synthesized using iterative Fmoc-based solid phase peptide synthesis methods. A small amount of solid support was withdrawn and suspended in aqueous ammonia (28-30 wt %) for 6 h. The cleaved compound was analyzed by LC-MS and the observed mass was consistent with structure. Mass m/z 1063.8 $[M+2H]^+$.

The solid support bound compound 142 was synthesized using solid phase peptide synthesis methods.

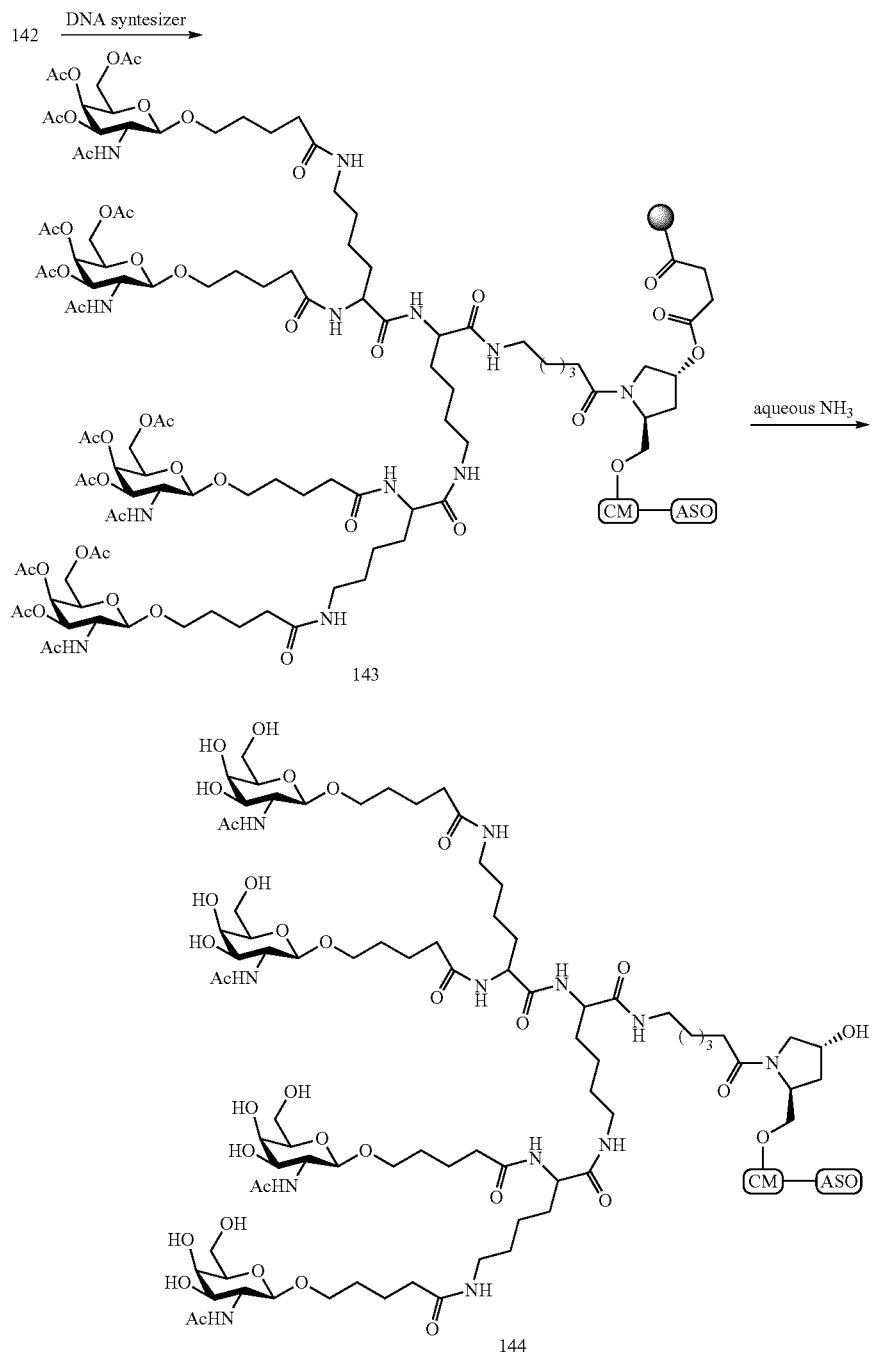

The solid support bound compound 143 was synthesized using standard solid phase synthesis on a DNA synthesizer.

The solid support bound compound 143 was suspended in aqueous ammonia (28-30 wt %) and heated at 55° C. for 16 h. The solution was cooled and the solid support was filtered. The filtrate was concentrated and the residue dissolved in water and purified by HPLC on a strong anion exchange column. The fractions containing full length compound 144 were pooled together and desalted. The resulting GalNAc$_4$-11 conjugated oligomeric compound was analyzed by LC-MS and the observed mass was consistent with structure.

The GalNAc$_4$ cluster portion of the conjugate group GalNAc$_4$-11 (GalNAc$_4$-11$_a$) can be combined with any cleavable moiety to provide a variety of conjugate groups. In certain embodiments, the cleavable moiety is —P(=O)(OH)-A$_d$-P(=O)(OH)—.

The structure of GalNAc$_4$-11 (GalNAc$_4$-11$_a$-CM) is shown below:

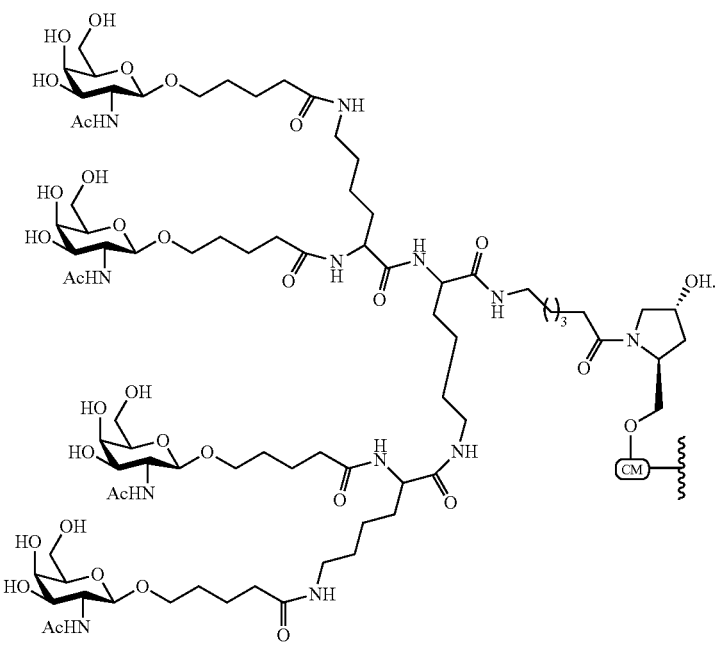
Example 51
Preparation of Oligonucleotide 155 Comprising GalNAc$_3$-6
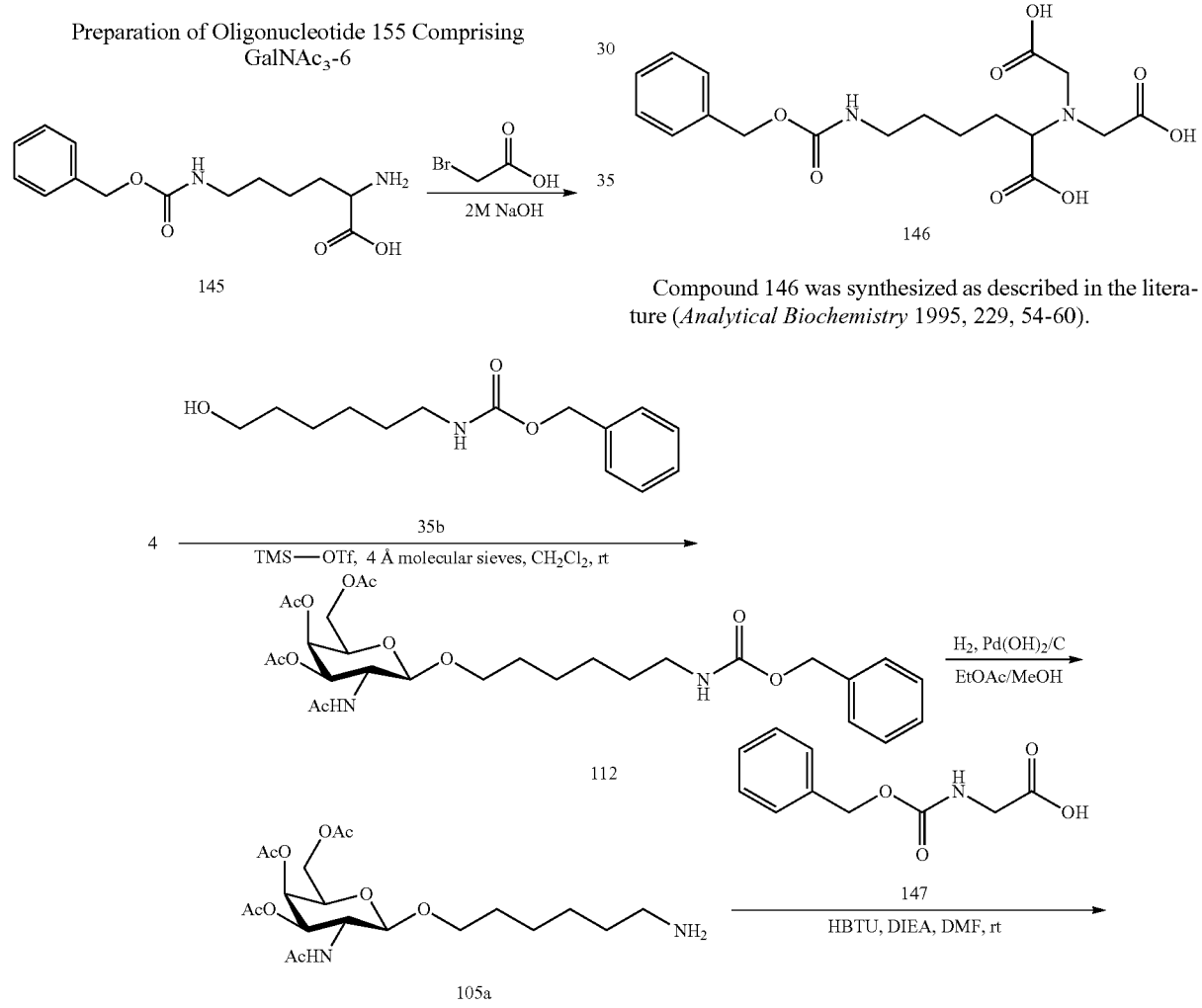
Compound 146 was synthesized as described in the literature (*Analytical Biochemistry* 1995, 229, 54-60).

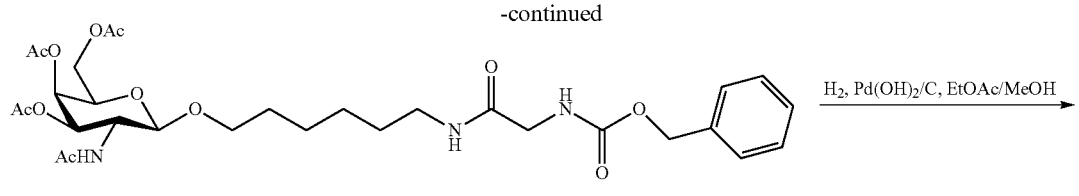

148

149

Compound 4 (15 g, 45.55 mmol) and compound 35b (14.3 grams, 57 mmol) were dissolved in CH$_2$Cl$_2$ (200 ml). Activated molecular sieves (4 Å, 2 g, powdered) were added, and the reaction was allowed to stir for 30 minutes under nitrogen atmosphere. TMS-OTf was added (4.1 ml, 22.77 mmol) and the reaction was allowed to stir at room temp overnight. Upon completion, the reaction was quenched by pouring into solution of saturated aqueous NaHCO$_3$ (500 ml) and crushed ice (~150 g). The organic layer was separated, washed with brine, dried over MgSO$_4$, filtered, and was concentrated to an orange oil under reduced pressure. The crude material was purified by silica gel column chromatography and eluted with 2-10% MeOH in CH$_2$Cl$_2$ to yield Compound 112 (16.53 g, 63%). LCMS and $^1$H NMR were consistent with the expected compound.

Compound 112 (4.27 g, 7.35 mmol) was dissolved in 1:1 MeOH/EtOAc (40 ml). The reaction mixture was purged by bubbling a stream of argon through the solution for 15 minutes. Pearlman's catalyst (palladium hydroxide on carbon, 400 mg) was added, and hydrogen gas was bubbled through the solution for 30 minutes. Upon completion (TLC 10% MeOH in CH$_2$Cl$_2$, and LCMS), the catalyst was removed by filtration through a pad of celite. The filtrate was concentrated by rotary evaporation, and was dried briefly under high vacuum to yield Compound 105a (3.28 g). LCMS and $^1$H NMR were consistent with desired product.

Compound 147 (2.31 g, 11 mmol) was dissolved in anhydrous DMF (100 mL). N,N-Diisopropylethylamine (DIEA, 3.9 mL, 22 mmol) was added, followed by HBTU (4 g, 10.5 mmol). The reaction mixture was allowed to stir for ~15 minutes under nitrogen. To this a solution of compound 105a (3.3 g, 7.4 mmol) in dry DMF was added and stirred for 2 h under nitrogen atmosphere. The reaction was diluted with EtOAc and washed with saturated aqueous NaHCO$_3$ and brine. The organics phase was separated, dried (MgSO$_4$), filtered, and concentrated to an orange syrup. The crude material was purified by column chromatography 2-5% MeOH in CH$_2$Cl$_2$ to yield Compound 148 (3.44 g, 73%). LCMS and $^1$H NMR were consistent with the expected product.

Compound 148 (3.3 g, 5.2 mmol) was dissolved in 1:1 MeOH/EtOAc (75 ml). The reaction mixture was purged by bubbling a stream of argon through the solution for 15 minutes. Pearlman's catalyst (palladium hydroxide on carbon) was added (350 mg). Hydrogen gas was bubbled through the solution for 30 minutes. Upon completion (TLC 10% MeOH in DCM, and LCMS), the catalyst was removed by filtration through a pad of celite. The filtrate was concentrated by rotary evaporation, and was dried briefly under high vacuum to yield Compound 149 (2.6 g). LCMS was consistent with desired product. The residue was dissolved in dry DMF (10 ml) was used immediately in the next step.

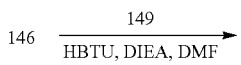

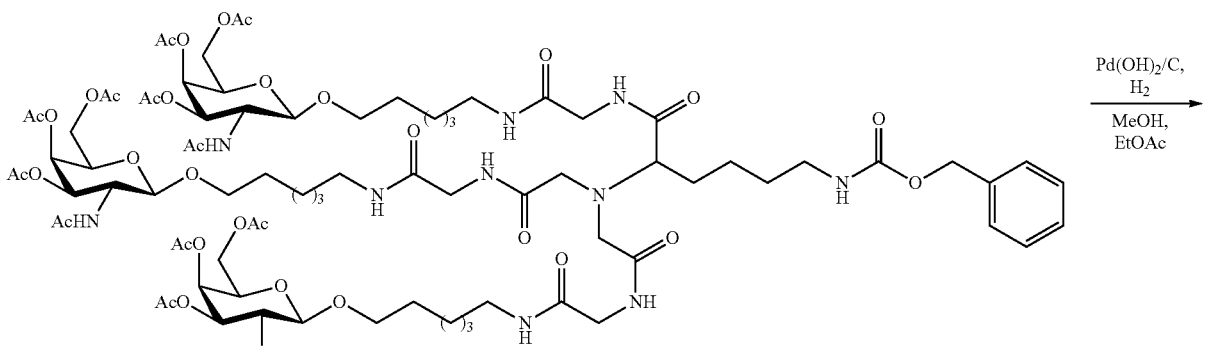

150

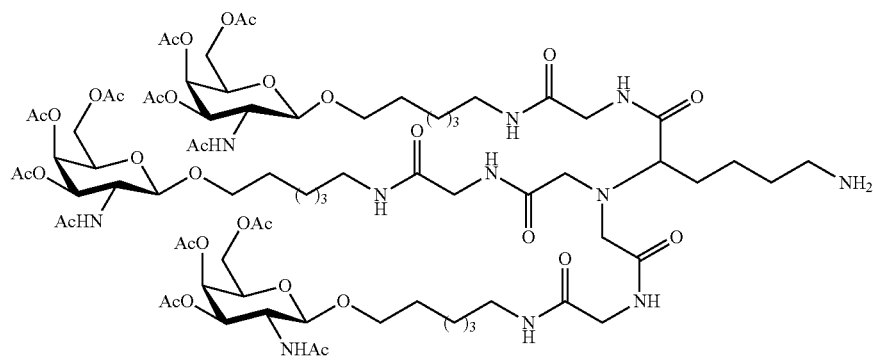

151

Compound 146 (0.68 g, 1.73 mmol) was dissolved in dry DMF (20 ml). To this DIEA (450 μL, 2.6 mmol, 1.5 eq.) and HBTU (1.96 g, 0.5.2 mmol) were added. The reaction mixture was allowed to stir for 15 minutes at room temperature under nitrogen. A solution of compound 149 (2.6 g) in anhydrous DMF (10 mL) was added. The pH of the reaction was adjusted to pH=9-10 by addition of DIEA (if necessary). The reaction was allowed to stir at room temperature under nitrogen for 2 h. Upon completion the reaction was diluted with EtOAc (100 mL), and washed with aqueous saturated aqueous NaHCO$_3$, followed by brine. The organic phase was separated, dried over MgSO$_4$, filtered, and concentrated. The residue was purified by silica gel column chromatography and eluted with 2-10% MeOH in CH$_2$Cl$_2$ to yield Compound 150 (0.62 g, 20%). LCMS and $^1$H NMR were consistent with the desired product. Compound 150 (0.62 g) was dissolved in 1:1 MeOH/EtOAc (5 L). The reaction mixture was purged by bubbling a stream of argon through the solution for 15 minutes. Pearlman's catalyst (palladium hydroxide on carbon) was added (60 mg). Hydrogen gas was bubbled through the solution for 30 minutes. Upon completion (TLC 10% MeOH in DCM, and LCMS), the catalyst was removed by filtration (syringe-tip Teflon filter, 0.45 μm). The filtrate was concentrated by rotary evaporation, and was dried briefly under high vacuum to yield Compound 151 (0.57 g). The LCMS was consistent with the desired product. The product was dissolved in 4 mL dry DMF and was used immediately in the next step.

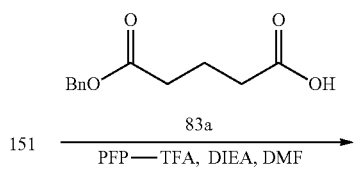

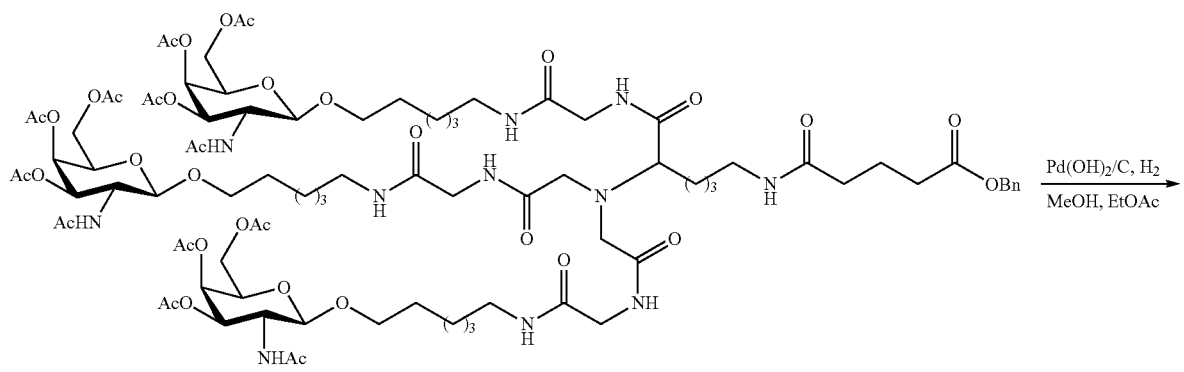

152

-continued

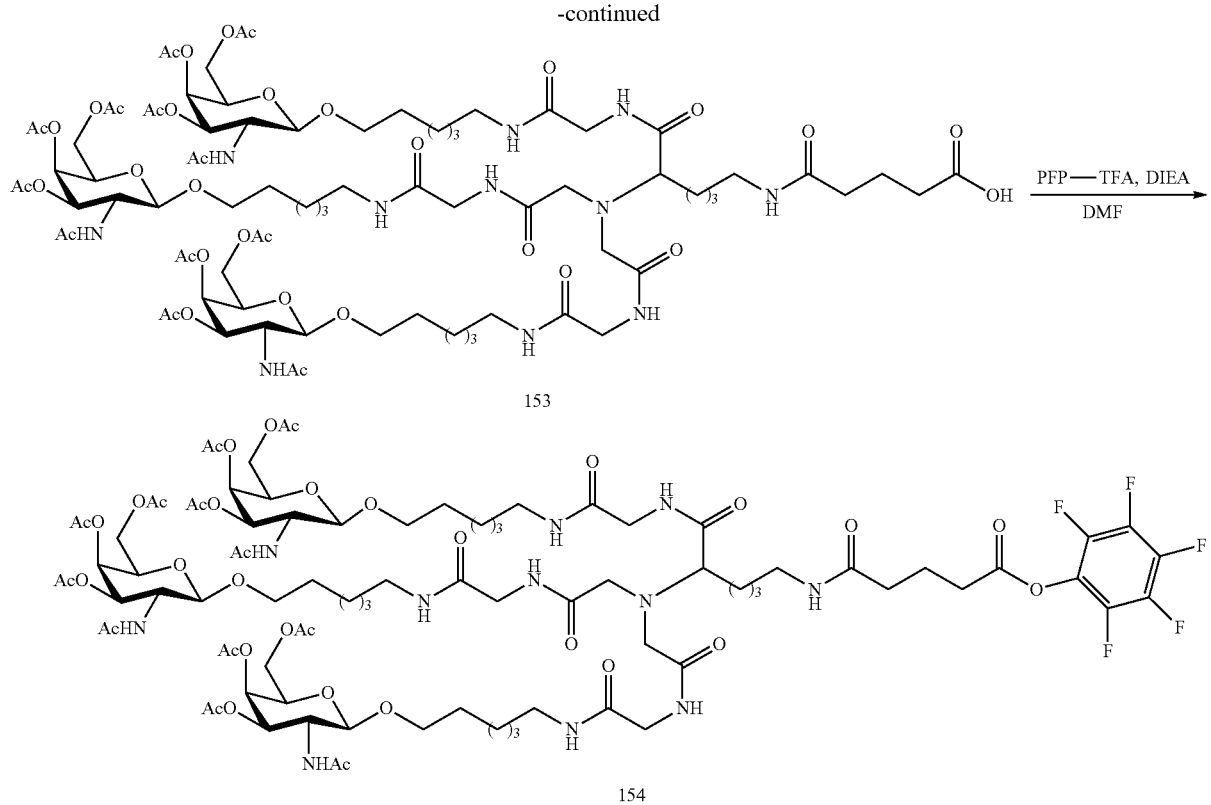

Compound 83a (0.11 g, 0.33 mmol) was dissolved in anhydrous DMF (5 mL) and N,N-Diisopropylethylamine (75 µL, 1 mmol) and PFP-TFA (90 µL, 0.76 mmol) were added. The reaction mixture turned magenta upon contact, and gradually turned orange over the next 30 minutes. Progress of reaction was monitored by TLC and LCMS. Upon completion (formation of the PFP ester), a solution of compound 151 (0.57 g, 0.33 mmol) in DMF was added. The pH of the reaction was adjusted to pH=9-10 by addition of N,N-Diisopropylethylamine (if necessary). The reaction mixture was stirred under nitrogen for ~30 min. Upon completion, the majority of the solvent was removed under reduced pressure. The residue was diluted with $CH_2Cl_2$ and washed with aqueous saturated $NaHCO_3$, followed by brine. The organic phase separated, dried over $MgSO_4$, filtered, and concentrated to an orange syrup. The residue was purified by silica gel column chromatography (2-10% MeOH in $CH_2Cl_2$) to yield Compound 152 (0.35 g, 55%). LCMS and $^1H$ NMR were consistent with the desired product.

Compound 152 (0.35 g, 0.182 mmol) was dissolved in 1:1 MeOH/EtOAc (10 mL). The reaction mixture was purged by bubbling a stream of argon thru the solution for 15 minutes. Pearlman's catalyst (palladium hydroxide on carbon) was added (35 mg). Hydrogen gas was bubbled thru the solution for 30 minutes. Upon completion (TLC 10% MeOH in DCM, and LCMS), the catalyst was removed by filtration (syringe-tip Teflon filter, 0.45 µm). The filtrate was concentrated by rotary evaporation, and was dried briefly under high vacuum to yield Compound 153 (0.33 g, quantitative). The LCMS was consistent with desired product.

Compound 153 (0.33 g, 0.18 mmol) was dissolved in anhydrous DMF (5 mL) with stirring under nitrogen. To this N,N-Diisopropylethylamine (65 µL, 0.37 mmol) and PFP-TFA (35 µL, 0.28 mmol) were added. The reaction mixture was stirred under nitrogen for ~30 min. The reaction mixture turned magenta upon contact, and gradually turned orange. The pH of the reaction mixture was maintained at pH=9-10 by adding more N,-Diisopropylethylamine. The progress of the reaction was monitored by TLC and LCMS. Upon completion, the majority of the solvent was removed under reduced pressure. The residue was diluted with $CH_2Cl_2$ (50 mL), and washed with saturated aqueous $NaHCO_3$, followed by brine. The organic layer was dried over $MgSO_4$, filtered, and concentrated to an orange syrup. The residue was purified by column chromatography and eluted with 2-10% MeOH in $CH_2Cl_2$ to yield Compound 154 (0.29 g, 79%). LCMS and $^1H$ NMR were consistent with the desired product.

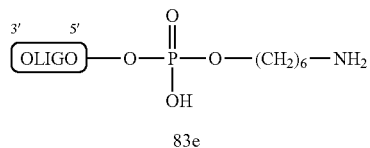

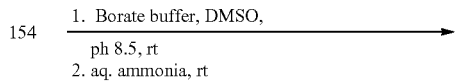

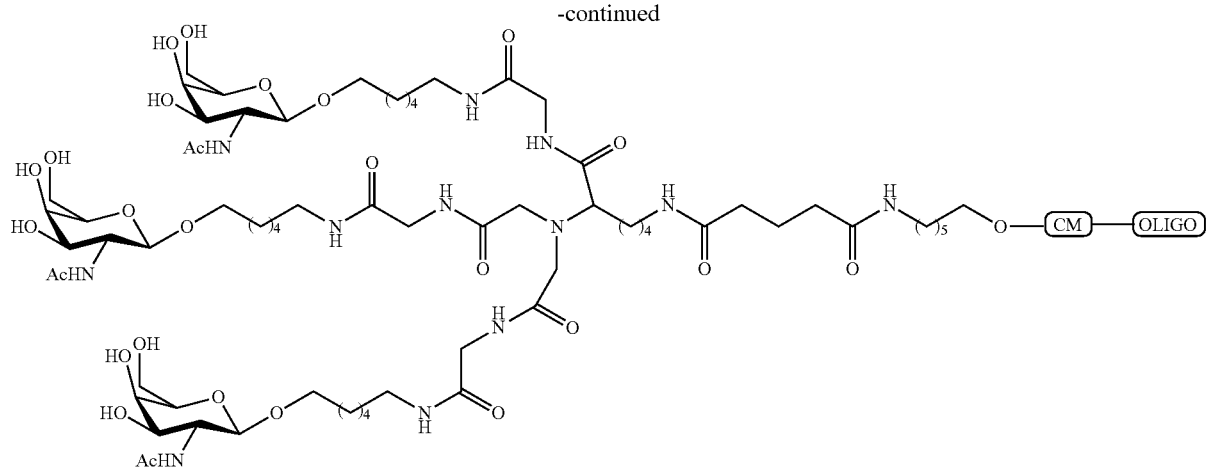

155

Oligomeric Compound 155, comprising a GalNAc$_3$-6 conjugate group, was prepared using the general procedures illustrated in Example 46. The GalNAc$_3$ cluster portion of the conjugate group GalNAc$_3$-6 (GalNAc$_3$-6$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-6 (GalNAc$_3$-6$_a$-CM-) is shown below:

-continued

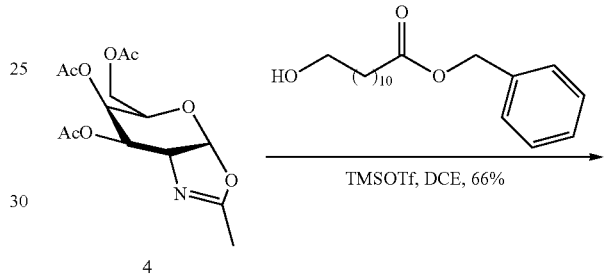

4

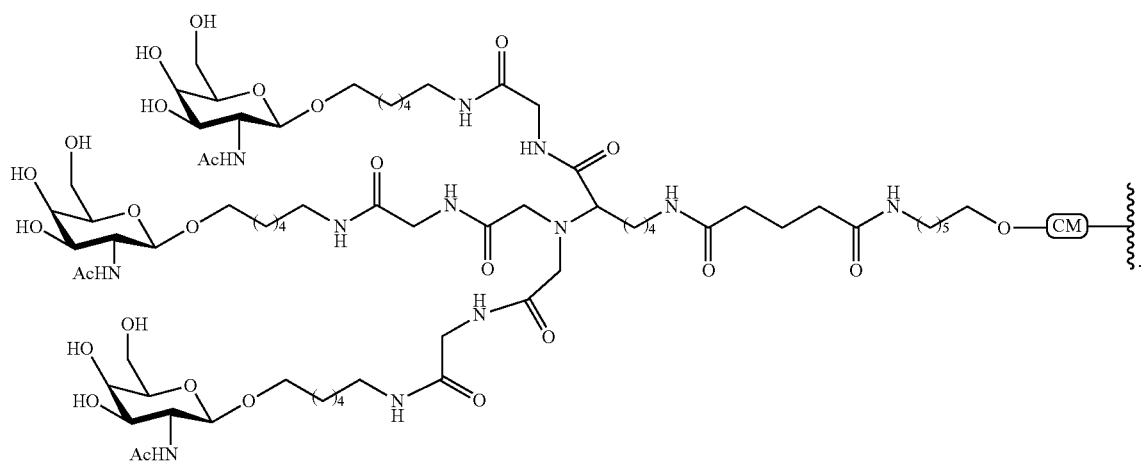

Example 52

Preparation of Oligonucleotide 160 Comprising GalNAc$_3$-9

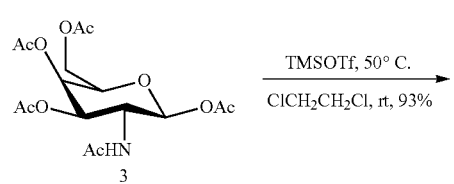

3

-continued

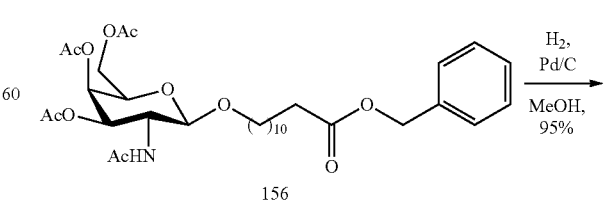

156

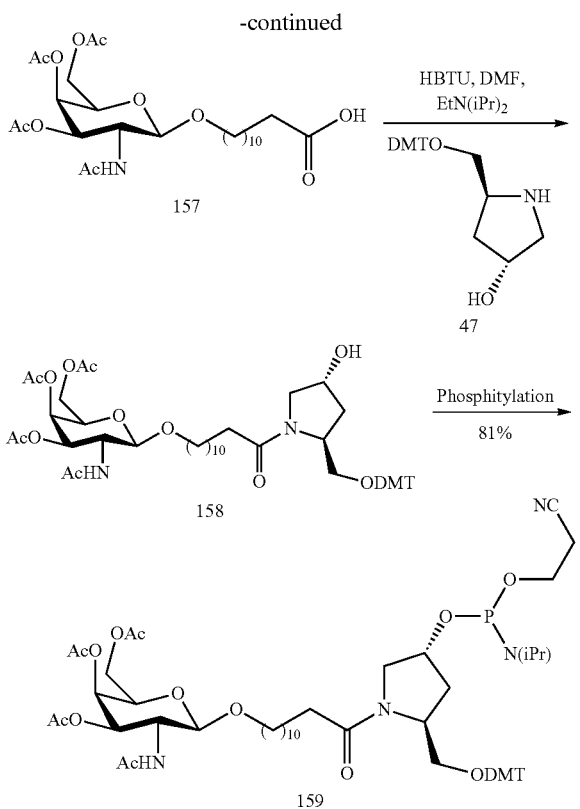

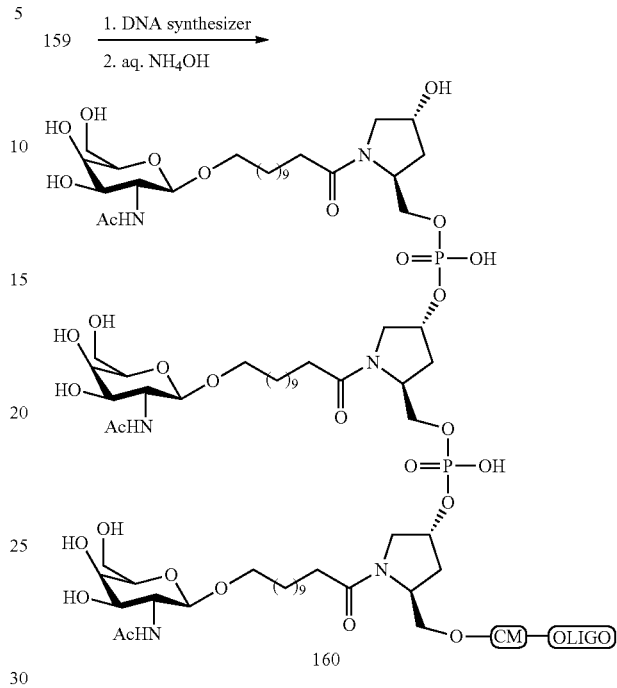

Compound 156 was synthesized following the procedure described in the literature (*J. Med. Chem.* 2004, 47, 5798-5808).

Compound 156, (18.60 g, 29.28 mmol) was dissolved in methanol (200 mL). Palladium on carbon (6.15 g, 10 wt %, loading (dry basis), matrix carbon powder, wet) was added. The reaction mixture was stirred at room temperature under hydrogen for 18 h. The reaction mixture was filtered through a pad of celite and the celite pad was washed thoroughly with methanol. The combined filtrate was washed and concentrated to dryness. The residue was purified by silica gel column chromatography and eluted with 5-10% methanol in dichloromethane to yield Compound 157 (14.26 g, 89%). Mass m/z 544.1 [M–H]−.

Compound 157 (5 g, 9.17 mmol) was dissolved in anhydrous DMF (30 mL). HBTU (3.65 g, 9.61 mmol) and N,N-Diisopropylethylamine (13.73 mL, 78.81 mmol) were added and the reaction mixture was stirred at room temperature for 5 minutes. To this a solution of compound 47 (2.96 g, 7.04 mmol) was added. The reaction was stirred at room temperature for 8 h. The reaction mixture was poured into a saturated NaHCO$_3$ aqueous solution. The mixture was extracted with ethyl acetate and the organic layer was washed with brine and dried (Na$_2$SO$_4$), filtered and evaporated. The residue obtained was purified by silica gel column chromatography and eluted with 50% ethyl acetate in hexane to yield compound 158 (8.25 g, 73.3%). The structure was confirmed by MS and $^1$H NMR analysis.

Compound 158 (7.2 g, 7.61 mmol) was dried over P$_2$O$_5$ under reduced pressure. The dried compound was dissolved in anhydrous DMF (50 mL). To this 1H-tetrazole (0.43 g, 6.09 mmol) and N-methylimidazole (0.3 mL, 3.81 mmol) and 2-cyanoethyl-N,N,N',N'-tetraisopropyl phosphorodiamidite (3.65 mL, 11.50 mmol) were added. The reaction mixture was stirred t under an argon atmosphere for 4 h. The reaction mixture was diluted with ethyl acetate (200 mL). The reaction mixture was washed with saturated NaHCO$_3$ and brine. The organic phase was separated, dried (Na$_2$SO$_4$), filtered and evaporated. The residue was purified by silica gel column chromatography and eluted with 50-90% ethyl acetate in hexane to yield Compound 159 (7.82 g, 80.5%). The structure was confirmed by LCMS and $^{31}$P NMR analysis.

Oligomeric Compound 160, comprising a GalNAc$_3$-9 conjugate group, was prepared using standard oligonucleotide synthesis procedures. Three units of compound 159 were coupled to the solid support, followed by nucleotide phosphoramidites. Treatment of the protected oligomeric compound with aqueous ammonia yielded compound 160. The GalNAc$_3$ cluster portion of the conjugate group GalNAc$_3$-9 (GalNAc$_3$-9$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-9 (GalNAc$_3$-9$_a$-CM) is shown below:

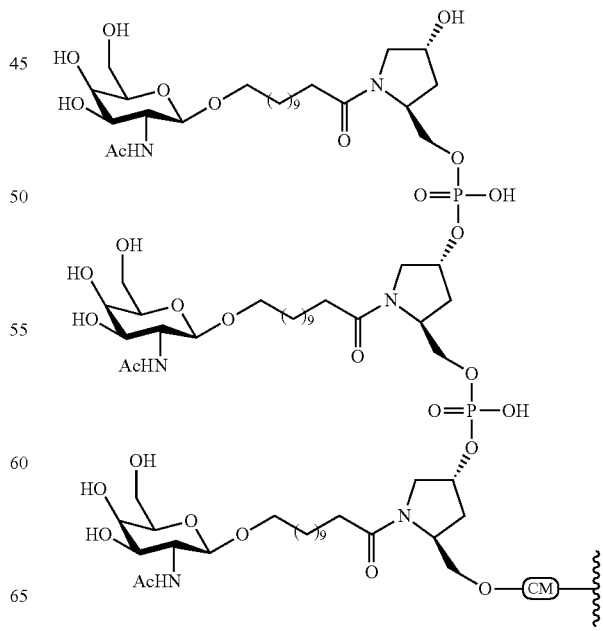

Example 53

Alternate Procedure for Preparation of Compound 18 (GalNAc₃-1a and GalNAc₃-3a)

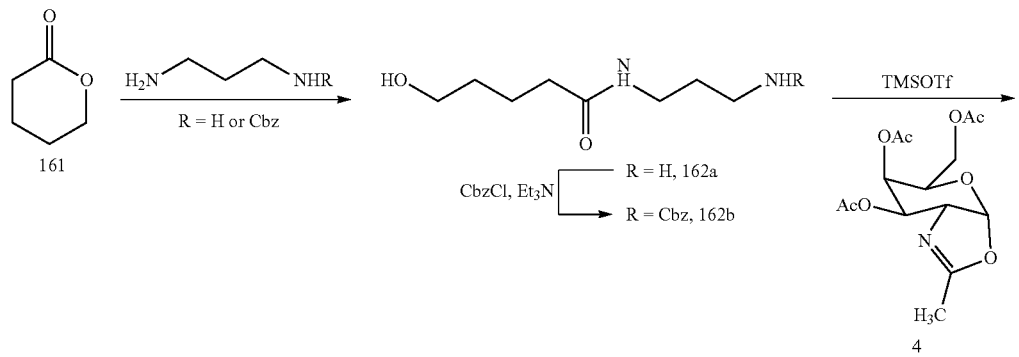

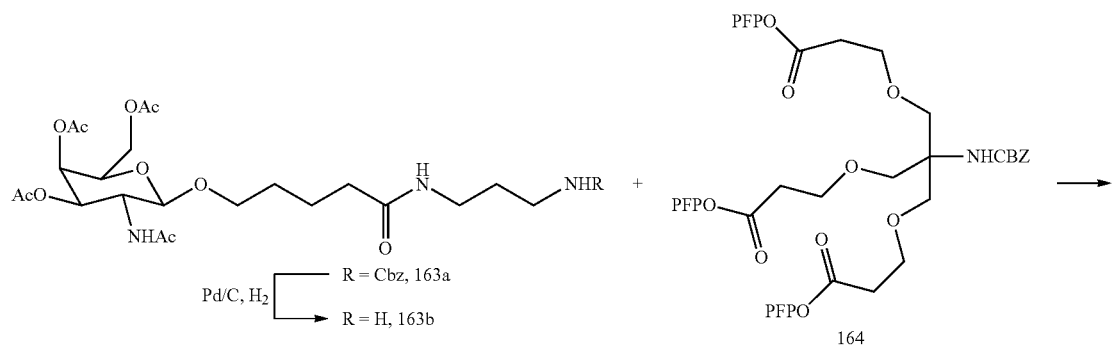

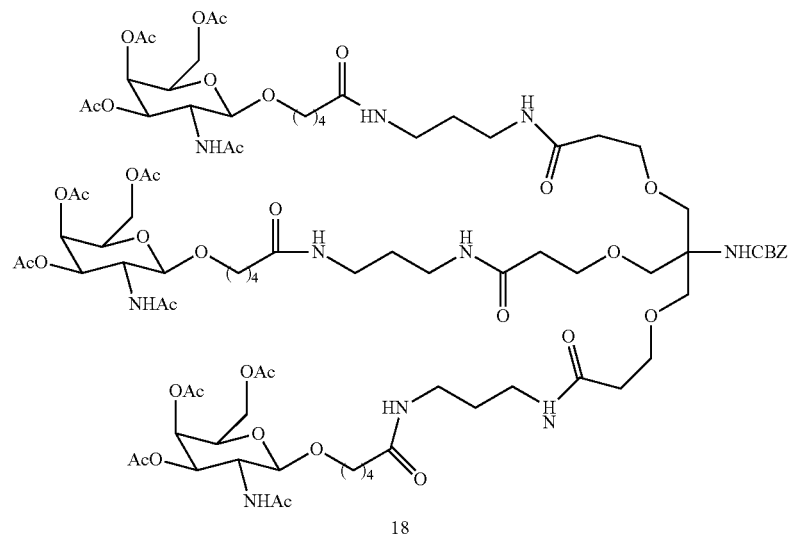

Lactone 161 was reacted with diamino propane (3-5 eq) or Mono-Boc protected diamino propane (1 eq) to provide alcohol 162a or 162b. When unprotected propanediamine was used for the above reaction, the excess diamine was removed by evaporation under high vacuum and the free amino group in 162a was protected using CbzCl to provide 162b as a white solid after purification by column chromatography. Alcohol 162b was further reacted with compound 4 in the presence of TMSOTf to provide 163a which was converted to 163b by removal of the Cbz group using catalytic hydrogenation. The pentafluorophenyl (PFP) ester 164 was prepared by reacting triacid 113 (see Example 48) with PFPTFA (3.5 eq) and pyridine (3.5 eq) in DMF (0.1 to 0.5 M). The triester 164 was directly reacted with the amine 163b (3-4 eq) and DIPEA (3-4 eq) to provide Compound 18. The above method greatly facilitates purification of intermediates and minimizes the formation of byproducts which are formed using the procedure described in Example 4.

Example 54

Alternate Procedure for Preparation of Compound 18 (GalNAc$_3$-1a and GalNAc$_3$-3a)

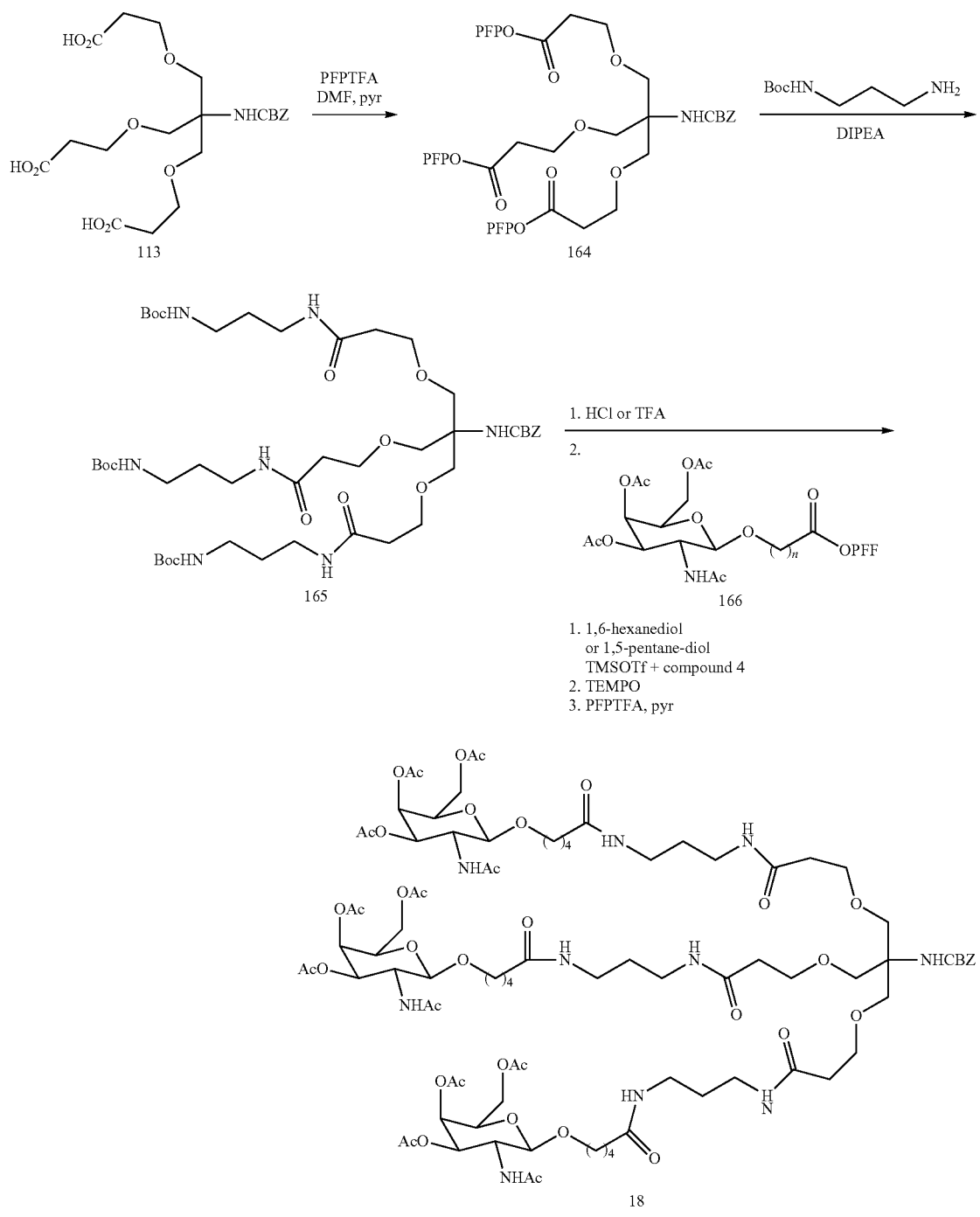

The triPFP ester 164 was prepared from acid 113 using the procedure outlined in example 53 above and reacted with mono-Boc protected diamine to provide 165 in essentially quantitative yield. The Boc groups were removed with hydrochloric acid or trifluoroacetic acid to provide the triamine which was reacted with the PFP activated acid 166 in the presence of a suitable base such as DIPEA to provide Compound 18.

The PFP protected Gal-NAc acid 166 was prepared from the corresponding acid by treatment with PFPTFA (1-1.2 eq) and pyridine (1-1.2 eq) in DMF. The precursor acid in turn was prepared from the corresponding alcohol by oxidation using TEMPO (0.2 eq) and BAIB in acetonitrile and water. The precursor alcohol was prepared from sugar intermediate 4 by reaction with 1,6-hexanediol (or 1,5-pentanediol or other diol for other n values) (2-4 eq) and TMSOTf using conditions described previously in example 47.

Example 55

Dose-Dependent Study of Oligonucleotides Comprising Either a 3' or 5'-Conjugate Group (Comparison of GalNAc$_3$-1, 3, 8 and 9) Targeting SRB-1 In Vivo The oligonucleotides listed below were tested in a dose-dependent study for antisense inhibition of SRB-1 in mice. Unconjugated ISIS 353382 was included as a standard. Each of the various GalNAc$_3$ conjugate groups was attached at either the 3' or 5' terminus of the respective oligonucleotide by a phosphodiester linked 2'-deoxyadenosine nucleoside (cleavable moiety).

dent manner. Indeed, the antisense oligonucleotides comprising the phosphodiester linked GalNAc$_3$-1 and GalNAc$_3$-9 conjugates at the 3' terminus (ISIS 655861 and ISIS 664078) and the GalNAc$_3$-3 and GalNAc$_3$-8 conjugates linked at the 5' terminus (ISIS 661161 and ISIS 665001) showed substantial improvement in potency compared to the unconjugated antisense oligonucleotide (ISIS 353382). Furthermore, ISIS 664078, comprising a GalNAc$_3$-9 conjugate at the 3' terminus was essentially equipotent compared to ISIS 655861, which comprises a GalNAc$_3$-1 conjugate at the 3' terminus. The 5' conjugated antisense oligonucleotides, ISIS 661161 and ISIS 665001, comprising a GalNAc$_3$-3 or GalNAc$_3$-9, respectively, had increased potency compared to the 3' conjugated antisense oligonucleotides (ISIS 655861 and ISIS 664078).

TABLE 39

Modified ASO targeting SRB-1

| ASO | Sequence (5' to 3') | Motif | Conjugate | SEQ ID No. |
|---|---|---|---|---|
| ISIS 353382 (parent) | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | none | 108 |
| ISIS 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{es}$T$_{eo}$A$_{do'}$-GalNAc$_3$-1$_a$ | 5/10/5 | GalNAc$_3$-1 | 110 |
| ISIS 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-9$_a$ | 5/10/5 | GalNAc$_3$-9 | 110 |
| ISIS 661161 | GalNAc$_3$-3$_{a-o'}$A$_{do}$ G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-3 | 109 |
| ISIS 665001 | GalNAc$_3$-8$_{a-o'}$A$_{do}$ G$_{es}$mC$_{es}$T$_{es}$T$_{es}$mC$_{es}$A$_{ds}$G$_{ds}$T$_{ds}$mC$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-8 | 109 |

Capital letters indicate the nucleobase for each nucleoside and $^m$C indicates a 5-methyl cytosine.
Subscripts:
"e" indicates 2'-MOE modified nucleoside;
"d" indicates β-D-2'-deoxyribonucleoside;
"s" indicates phosphorothioate internucleoside linkages (PS);
"o" indicates phosphodiester internucleoside linkages (PO);
and "o'" indicates —O—P(=O)(OH)—.
Conjugate groups are in bold.
The structure of GalNAc$_3$-1$_a$ was shown previously in Example 9.
The structure of GalNAc$_3$-9 was shown previously in Example 52.
The structure of GalNAc$_3$-3 was shown previously in Example 39.
The structure of GalNAc$_3$-8 was shown previously in Example 47.

Treatment

Six week old male Balb/c mice (Jackson Laboratory, Bar Harbor, Me.) were injected subcutaneously once at the dosage shown below with ISIS 353382, 655861, 664078, 661161, 665001 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 40, treatment with antisense oligonucleotides lowered SRB-1 mRNA levels in a dose-depen-

TABLE 40

ASOs containing GalNAc$_3$-1, 3, 8 or 9 targeting SRB-1

| ISIS No. | Dosage (mg/kg) | SRB-1 mRNA (% Saline) | Conjugate |
|---|---|---|---|
| Saline | n/a | 100 | |
| 353382 | 3 | 88 | none |
| | 10 | 68 | |
| | 30 | 36 | |
| 655861 | 0.5 | 98 | GalNac$_3$-1 (3') |
| | 1.5 | 76 | |
| | 5 | 31 | |
| | 15 | 20 | |

TABLE 40-continued

ASOs containing GalNAc₃-1, 3, 8 or 9 targeting SRB-1

| ISIS No. | Dosage (mg/kg) | SRB-1 mRNA (% Saline) | Conjugate |
|---|---|---|---|
| 664078 | 0.5 | 88 | GalNac₃-9 (3') |
|  | 1.5 | 85 |  |
|  | 5 | 46 |  |
|  | 15 | 20 |  |
| 661161 | 0.5 | 92 | GalNac₃-3 (5') |
|  | 1.5 | 59 |  |
|  | 5 | 19 |  |
|  | 15 | 11 |  |
| 665001 | 0.5 | 100 | GalNac₃-8 (5') |
|  | 1.5 | 73 |  |
|  | 5 | 29 |  |
|  | 15 | 13 |  |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in the table below.

TABLE 41

| ISIS No. | Dosage mg/kg | ALT | AST | Total Bilirubin | BUN | Conjugate |
|---|---|---|---|---|---|---|
| Saline |  | 24 | 59 | 0.1 | 37.52 |  |
| 353382 | 3 | 21 | 66 | 0.2 | 34.65 | none |
|  | 10 | 22 | 54 | 0.2 | 34.2 |  |
|  | 30 | 22 | 49 | 0.2 | 33.72 |  |

TABLE 41-continued

| ISIS No. | Dosage mg/kg | ALT | AST | Total Bilirubin | BUN | Conjugate |
|---|---|---|---|---|---|---|
| 655861 | 0.5 | 25 | 62 | 0.2 | 30.65 | GalNac₃-1 (3') |
|  | 1.5 | 23 | 48 | 0.2 | 30.97 |  |
|  | 5 | 28 | 49 | 0.1 | 32.92 |  |
|  | 15 | 40 | 97 | 0.1 | 31.62 |  |
| 664078 | 0.5 | 40 | 74 | 0.1 | 35.3 | GalNac₃-9 (3') |
|  | 1.5 | 47 | 104 | 0.1 | 32.75 |  |
|  | 5 | 20 | 43 | 0.1 | 30.62 |  |
|  | 15 | 38 | 92 | 0.1 | 26.2 |  |
| 661161 | 0.5 | 101 | 162 | 0.1 | 34.17 | GalNac₃-3 (5') |
|  | 1.5 g | 42 | 100 | 0.1 | 33.37 |  |
|  | 5 g | 23 | 99 | 0.1 | 34.97 |  |
|  | 15 | 53 | 83 | 0.1 | 34.8 |  |
| 665001 | 0.5 | 28 | 54 | 0.1 | 31.32 | GalNac₃-8 (5') |
|  | 1.5 | 42 | 75 | 0.1 | 32.32 |  |
|  | 5 | 24 | 42 | 0.1 | 31.85 |  |
|  | 15 | 32 | 67 | 0.1 | 31. |  |

Example 56

Dose-Dependent Study of Oligonucleotides Comprising Either a 3' or 5'-Conjugate Group (Comparison of GalNAc₃-1, 2, 3, 5, 6, 7 and 10) Targeting SRB-1 In Vivo The oligonucleotides listed below were tested in a dose-dependent study for antisense inhibition of SRB-1 in mice. Unconjugated ISIS 353382 was included as a standard. Each of the various GalNAc₃ conjugate groups was attached at the 5' terminus of the respective oligonucleotide by a phosphodiester linked 2'-deoxyadenosine nucleoside (cleavable moiety) except for ISIS 655861 which had the GalNAc₃ conjugate group attached at the 3' terminus.

TABLE 42

Modified ASO targeting SRB-1

| ASO | Sequence (5' to 3') | Motif | Conjugate | SEQ ID No. |
|---|---|---|---|---|
| ISIS 353382 (parent) | $G_{es}{}^mC_{es}T_{es}T_{es}{}^mC_{es}A_{ds}G_{ds}T_{ds}{}^mC_{ds}A_{ds}T_{ds}G_{ds}A_{ds}{}^m$ $C_{ds}T_{ds}T_{es}{}^mC_{es}{}^mC_{es}T_{es}T_{e}$ | 5/10/5 | no conjugate | 108 |
| ISIS 655861 | $G_{es}{}^mC_{es}T_{es}T_{es}{}^mC_{es}A_{ds}G_{ds}T_{ds}{}^mC_{ds}A_{ds}T_{ds}G_{ds}A_{ds}{}^m$ $C_{ds}T_{ds}T_{es}{}^mC_{es}{}^mC_{es}T_{es}T_{eo}A_{do'}\text{-}\mathbf{GalNAc_3\text{-}1}_a$ | 5/10/5 | GalNAc₃-1 | 110 |
| ISIS 664507 | $\mathbf{GalNAc_3\text{-}2}_{a\text{-}o'}A_{do}G_{es}{}^mC_{es}T_{es}T_{es}{}^mC_{es}A_{ds}G_{ds}T_{ds}{}^m$ $C_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc₃-2 | 109 |
| ISIS 661161 | $\mathbf{GalNAc_3\text{-}3}_{a\text{-}o'}A_{do}$ $G_{es}{}^mC_{es}T_{es}T_{es}{}^mC_{es}A_{ds}G_{ds}T_{ds}{}^mC_{ds}A_{ds}T_{ds}G_{ds}A_{ds}{}^m$ $C_{ds}T_{ds}T_{es}{}^mC_{es}{}^mC_{es}T_{es}T_{e}$ | 5/10/5 | GalNAc₃-3 | 109 |
| ISIS 666224 | $\mathbf{GalNAc_3\text{-}5}_{a\text{-}o'}A_{do}G_{es}{}^mC_{es}T_{es}T_{es}{}^mC_{es}A_{ds}G_{ds}T_{as}{}^m$ $C_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc₃-5 | 109 |
| ISIS 666961 | $\mathbf{GalNAc_3\text{-}6}_{a\text{-}o'}A_{do}G_{es}{}^mC_{es}T_{es}T_{es}C_{es}A_{ds}G_{ds}T_{ds}{}^m$ $C_{ds}A_{ds}T_{ds}G_{ds}A_{ds}{}^mC_{ds}T_{as}T_{es}{}^mC_{es}{}^mC_{es}T_{es}T_{e}$ | 5/10/5 | GalNAc₃-6 | 109 |
| ISIS 666981 | $\mathbf{GalNAc_3\text{-}7}_{a\text{-}o'}A_{do}G_{es}{}^mC_{es}T_{es}T_{es}C_{es}A_{ds}G_{ds}T_{ds}{}^m$ $C_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc₃-7 | 109 |

TABLE 42-continued

Modified ASO targeting SRB-1

| ASO | Sequence (5' to 3') | Motif | Conjugate | SEQ ID No. |
|---|---|---|---|---|
| ISIS 666881 | GalNAc$_3$-10$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$mC$_{ds}$T$_{ds}$T$_{es}$mC$_{es}$mC$_{es}$T$_{es}$T$_{e}$ | 5/10/5 | GalNAc$_3$-10 | 109 |

Capital letters indicate the nucleobase for each nucleoside and $^m$C indicates a 5-methyl cytosine.
Subscripts:
"e" indicates 2'-MOE modified nucleoside;
"d" indicates β-D-2'-deoxyribonucleoside;
"s" indicates phosphorothioate internucleoside linkages (PS);
"o" indicates phosphodiester internucleoside linkages (PO);
and "o'" indicates —O—P(═O)(OH)—.
Conjugate groups are in bold.
The structure of GalNAc$_3$-1$_a$ was shown previously in Example 9.
The structure of GalNAc$_3$-2$_a$ was shown previously in Example 37.
The structure of GalNAc$_3$-3$_a$ was shown previously in Example 39.
The structure of GalNAc$_3$-5$_a$ was shown previously in Example 49.
The structure of GalNAc$_3$-6$_a$ was shown previously in Example 51.
The structure of GalNAc$_3$-7$_a$ was shown previously in Example 48.
The structure of GalNAc$_3$-10$_a$ was shown previously in Example 46.

Treatment

Six week old male Balb/c mice (Jackson Laboratory, Bar Harbor, Me.) were injected subcutaneously once at the dosage shown below with ISIS 353382, 655861, 664507, 661161, 666224, 666961, 666981, 666881 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 43, treatment with antisense oligonucleotides lowered SRB-1 mRNA levels in a dose-dependent manner. Indeed, the conjugated antisense oligonucleotides showed substantial improvement in potency compared to the unconjugated antisense oligonucleotide (ISIS 353382). The 5' conjugated antisense oligonucleotides showed a slight increase in potency compared to the 3' conjugated antisense oligonucleotide.

TABLE 43

| ISIS No. | Dosage (mg/kg) | SRB-1 mRNA (% Saline) | Conjugate |
|---|---|---|---|
| Saline | n/a | 100.0 | |
| 353382 | 3 | 96.0 | none |
| | 10 | 73.1 | |
| | 30 | 36.1 | |
| 655861 | 0.5 | 99.4 | GalNac$_3$-1 (3') |
| | 1.5 | 81.2 | |
| | 5 | 33.9 | |
| | 15 | 15.2 | |
| 664507 | 0.5 | 102.0 | GalNac$_3$-2 (5') |
| | 1.5 | 73.2 | |
| | 5 | 31.3 | |
| | 15 | 10.8 | |
| 661161 | 0.5 | 90.7 | GalNac$_3$-3 (5') |
| | 1.5 | 67.6 | |
| | 5 | 24.3 | |
| | 15 | 11.5 | |
| 666224 | 0.5 | 96.1 | GalNac$_3$-5 (5') |
| | 1.5 | 61.6 | |
| | 5 | 25.6 | |
| | 15 | 11.7 | |

TABLE 43-continued

| ISIS No. | Dosage (mg/kg) | SRB-1 mRNA (% Saline) | Conjugate |
|---|---|---|---|
| 666961 | 0.5 | 85.5 | GalNAc$_3$-6 (5') |
| | 1.5 | 56.3 | |
| | 5 | 34.2 | |
| | 15 | 13.1 | |
| 666981 | 0.5 | 84.7 | GalNAc$_3$-7 (5') |
| | 1.5 | 59.9 | |
| | 5 | 24.9 | |
| | 15 | 8.5 | |
| 666881 | 0.5 | 100.0 | GalNAc$_3$-10 (5') |
| | 1.5 | 65.8 | |
| | 5 | 26.0 | |
| | 15 | 13.0 | |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 44 below.

TABLE 44

| ISIS No. | Dosage mg/kg | ALT | AST | Total Bilirubin | BUN | Conjugate |
|---|---|---|---|---|---|---|
| Saline | | 26 | 57 | 0.2 | 27 | |
| 353382 | 3 | 25 | 92 | 0.2 | 27 | none |
| | 10 | 23 | 40 | 0.2 | 25 | |
| | 30 | 29 | 54 | 0.1 | 28 | |
| 655861 | 0.5 | 25 | 71 | 0.2 | 34 | GalNac$_3$-1 (3') |
| | 1.5 | 28 | 60 | 0.2 | 26 | |
| | 5 | 26 | 63 | 0.2 | 28 | |
| | 15 | 25 | 61 | 0.2 | 28 | |
| 664507 | 0.5 | 25 | 62 | 0.2 | 25 | GalNac$_3$-2 (5') |
| | 1.5 | 24 | 49 | 0.2 | 26 | |
| | 5 | 21 | 50 | 0.2 | 26 | |
| | 15 | 59 | 84 | 0.1 | 22 | |
| 661161 | 0.5 | 20 | 42 | 0.2 | 29 | GalNac$_3$-3 (5') |
| | 1.5 g | 37 | 74 | 0.2 | 25 | |
| | 5 g | 28 | 61 | 0.2 | 29 | |
| | 15 | 21 | 41 | 0.2 | 25 | |
| 666224 | 0.5 | 34 | 48 | 0.2 | 21 | GalNac$_3$-5 (5') |
| | 1.5 | 23 | 46 | 0.2 | 26 | |
| | 5 | 24 | 47 | 0.2 | 23 | |
| | 15 | 32 | 49 | 0.1 | 26 | |

TABLE 44-continued

| ISIS No. | Dosage mg/kg | ALT | AST | Total Bilirubin | BUN | Conjugate |
|---|---|---|---|---|---|---|
| 666961 | 0.5 | 17 | 63 | 0.2 | 26 | GalNAc$_3$-6 (5') |
| | 1.5 | 23 | 68 | 0.2 | 26 | |
| | 5 | 25 | 66 | 0.2 | 26 | |
| | 15 | 29 | 107 | 0.2 | 28 | |
| 666981 | 0.5 | 24 | 48 | 0.2 | 26 | GalNAc$_3$-7 (5') |
| | 1.5 | 30 | 55 | 0.2 | 24 | |
| | 5 | 46 | 74 | 0.1 | 24 | |
| | 15 | 29 | 58 | 0.1 | 26 | |
| 666881 | 0.5 | 20 | 65 | 0.2 | 27 | GalNAc$_3$-10 (5') |
| | 1.5 | 23 | 59 | 0.2 | 24 | |
| | 5 | 45 | 70 | 0.2 | 26 | |
| | 15 | 21 | 57 | 0.2 | 24 | |

Example 57

Duration of Action Study of Oligonucleotides Comprising a 3'-Conjugate Group Targeting ApoC III In Vivo Mice were injected once with the doses indicated below and monitored over the course of 42 days for ApoC-III and plasma triglycerides (Plasma TG) levels. The study was performed using 3 transgenic mice that express human APOC-III in each group.

TABLE 45

Modified ASO targeting ApoC III

| ASO | Sequence (5' to 3') | Linkages | SEQ ID No. |
|---|---|---|---|
| ISIS 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | PS | 32 |
| ISIS 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do'}$-GalNAc$_3$-1$_a$ | PS | 111 |
| ISIS 647536 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{eo}$T$_{eo}$T$_{eo}$A$_{es}$T$_{eo}$A$_{do'}$-GalNAc$_3$-1$_a$ | PO/PS | 111 |

Capital letters indicate the nucleobase for each nucleoside and $^m$C indicates a 5-methylcytosine.
Subscripts:
"e" indicates 2'-MOE modified nucleoside;
"d" indicates β-D-2'-deoxyribonucleoside;
"s" indicates phosphorothioate internucleoside linkages (PS);
"o" indicates phosphodiester internucleoside linkages (PO);
and "o'" indicates —O—P(═O)(OH)—.
Conjugate groups are in bold.
The structure of GalNAc$_3$-1$_a$ was shown previously in Example 9.

TABLE 46

ApoC III mRNA (% Saline on Day 1) and Plasma TG Levels (% Saline on Day 1)

| ASO | Dose | Target | Day 3 | Day 7 | Day 14 | Day 35 | Day 42 |
|---|---|---|---|---|---|---|---|
| Saline | 0 mg/kg | ApoC-III | 98 | 100 | 100 | 95 | 116 |
| ISIS 304801 | 30 mg/kg | ApoC-III | 28 | 30 | 41 | 65 | 74 |
| ISIS 647535 | 10 mg/kg | ApoC-III | 16 | 19 | 25 | 74 | 94 |
| ISIS 647536 | 10 mg/kg | ApoC-III | 18 | 16 | 17 | 35 | 51 |
| Saline | 0 mg/kg | Plasma TG | 121 | 130 | 123 | 105 | 109 |

TABLE 46-continued

ApoC III mRNA (% Saline on Day 1) and Plasma TG Levels (% Saline on Day 1)

| ASO | Dose | Target | Day 3 | Day 7 | Day 14 | Day 35 | Day 42 |
|---|---|---|---|---|---|---|---|
| ISIS 304801 | 30 mg/kg | Plasma TG | 34 | 37 | 50 | 69 | 69 |
| ISIS 647535 | 10 mg/kg | Plasma TG | 18 | 14 | 24 | 18 | 71 |
| ISIS 647536 | 10 mg/kg | Plasma TG | 21 | 19 | 15 | 32 | 35 |

As can be seen in the table above the duration of action increased with addition of the 3'-conjugate group compared to the unconjugated oligonucleotide. There was a further increase in the duration of action for the conjugated mixed PO/PS oligonucleotide 647536 as compared to the conjugated full PS oligonucleotide 647535.

Example 58

Dose-Dependent Study of Oligonucleotides Comprising a 3'-Conjugate Group (Comparison of GalNAc$_3$-1 and GalNAc$_4$-11) Targeting SRB-1 In Vivo The oligonucleotides listed below were tested in a dose-dependent study for antisense inhibition of SRB-1 in mice. Unconjugated ISIS 440762 was included as an unconjugated standard. Each of the conjugate groups were attached at the 3' terminus of the respective oligonucleotide by a phosphodiester linked 2'-deoxyadenosine nucleoside cleavable moiety.

The structure of GalNAc$_3$-1$_a$ was shown previously in Example 9. The structure of GalNAc$_3$-11$_a$ was shown previously in Example 50.

Treatment

Six week old male Balb/c mice (Jackson Laboratory, Bar Harbor, Me.) were injected subcutaneously once at the dosage shown below with ISIS 440762, 651900, 663748 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 47, treatment with antisense oligonucleotides lowered SRB-1 mRNA levels in a dose-dependent manner. The antisense oligonucleotides comprising the phosphodiester linked GalNAc$_3$-1 and GalNAc$_4$-11 conjugates at the 3' terminus (ISIS 651900 and ISIS 663748) showed substantial improvement in potency compared to the unconjugated antisense oligonucleotide (ISIS 440762). The two conjugated oligonucleotides, GalNAc$_3$-1 and GalNAc$_4$-11, were equipotent.

TABLE 47

Modified ASO targeting SRB-1

| ASO | Sequence (5' to 3') | Dose mg/kg | % Saline control | SEQ ID No. |
|---|---|---|---|---|
| Saline | | | 100 | |
| ISIS 440762 | $T_{ks}{}^mC_{ks}A_{ds}G_{ds}T_{ds}{}^mC_{ds}A_{ds}T_{ds}G_{ds}A_{ds}{}^m$$C_{ds}T_{ds}T_{ks}{}^mC_k$ | 0.6<br>2<br>6 | 73.45<br>59.66<br>23.50 | 104 |
| ISIS 651900 | $T_{ks}{}^mC_{ks}A_{ds}G_{ds}T_{ds}{}^mC_{ds}A_{ds}T_{ds}G_{ds}A_{ds}{}^m$$C_{ds}T_{ds}T_{ks}{}^mC_{ko}A_{do'}$-GalNAc$_3$-1$_a$ | 0.2<br>0.6<br>2<br>6 | 62.75<br>29.14<br>8.61<br>5.62 | 112 |
| ISIS 663748 | $T_{ks}{}^mC_{ks}A_{ds}G_{ds}T_{ds}{}^mC_{ds}A_{ds}T_{ds}G_{ds}A_{ds}{}^m$$C_{ds}T_{ds}T_{ks}{}^mC_koA_{do'}$-GalNAc$_4$-11$_a$ | 0.2<br>0.6<br>2<br>6 | 63.99<br>33.53<br>7.58<br>5.52 | 112 |

Capital letters indicate the nucleobase for each nucleoside and $^mC$ indicates a 5-methyl cytosine.
Subscripts:
"e" indicates 2'-MOE modified nucleoside;
"k" indicates 6'-(S)-CH$_3$ bicyclic nucleoside;
"d" indicates β-D-2'-deoxyribonucleoside;
"s" indicates phosphorothioate internucleoside linkages (PS);
"o" indicates phosphodiester internucleoside linkages (PO);
and "o'" indicates —O—P(=O)(OH)—.
Conjugate groups are in bold.

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 48 below.

TABLE 48

| ISIS No. | Dosage mg/kg | ALT | AST | Total Bilirubin | BUN | Conjugate |
|---|---|---|---|---|---|---|
| Saline | | 30 | 76 | 0.2 | 40 | |
| 440762 | 0.60 | 32 | 70 | 0.1 | 35 | none |
| | 2 | 26 | 57 | 0.1 | 35 | |
| | 6 | 31 | 48 | 0.1 | 39 | |
| 651900 | 0.2 | 32 | 115 | 0.2 | 39 | GalNac$_3$-1 (3') |
| | 0.6 | 33 | 61 | 0.1 | 35 | |
| | 2 | 30 | 50 | 0.1 | 37 | |
| | 6 | 34 | 52 | 0.1 | 36 | |
| 663748 | 0.2 | 28 | 56 | 0.2 | 36 | GalNac$_4$-11 (3') |
| | 0.6 | 34 | 60 | 0.1 | 35 | |
| | 2 | 44 | 62 | 0.1 | 36 | |
| | 6 | 38 | 71 | 0.1 | 33 | |

Example 59

Effects of GalNAc$_3$-1 Conjugated ASOs Targeting FXI In Vivo

The oligonucleotides listed below were tested in a multiple dose study for antisense inhibition of FXI in mice. ISIS 404071 was included as an unconjugated standard. Each of the conjugate groups was attached at the 3' terminus of the respective oligonucleotide by a phosphodiester linked 2'-deoxyadenosine nucleoside cleavable moiety.

TABLE 49

Modified ASOs targeting FXI

| ASO | Sequence (5' to 3') | Linkages | SEQ ID No. |
|---|---|---|---|
| ISIS 404071 | $T_{es}G_{es}G_{es}T_{es}A_{es}A_{ds}T_{ds}{}^mC_{ds}{}^mC_{ds}A_{ds}{}^mC_{ds}$$T_{ds}T_{ds}T_{ds}{}^mC_{ds}A_{es}G_{es}A_{es}G_{es}G_e$ | PS | 115 |
| ISIS 656172 | $T_{es}G_{es}G_{es}T_{es}A_{es}A_{ds}T_{ds}{}^mC_{ds}{}^mC_{ds}A_{ds}{}^mC_{ds}$$T_{ds}T_{ds}T_{ds}{}^mC_{ds}A_{es}G_{es}A_{es}G_{es}G_{eo}A_{do'}$-GalNAc$_3$-1$_a$ | PS | 113 |
| ISIS 656173 | $T_{es}G_{eo}G_{eo}T_{eo}A_{eo}A_{ds}T_{ds}{}^mC_{ds}{}^mC_{ds}A_{ds}{}^mC_{ds}$$T_{ds}T_{ds}T_{ds}{}^mC_{ds}A_{eo}G_{eo}A_{es}G_{es}G_{eo}A_{do'}$-GalNAc$_3$-1$_a$ | PO/PS | 113 |

Capital letters indicate the nucleobase for each nucleoside and $^mC$ indicates a 5-methyl cytosine.
Subscripts:
"e" indicates a 2'-MOE modified nucleoside;
"d" indicates a β-D-2'-deoxyribonucleoside;
"s" indicates a phosphorothioate internucleoside linkage (PS);
"o" indicates a phosphodiester internucleoside linkage (PO); and
"o'" indicates —O—P(=O)(OH)—.
Conjugate groups are in bold.
The structure of GalNAc$_3$-1$_a$ was shown previously in Example 9.

Treatment

Six week old male Balb/c mice (Jackson Laboratory, Bar Harbor, Me.) were injected subcutaneously twice a week for 3 weeks at the dosage shown below with ISIS 404071, 656172, 656173 or with PBS treated control. Each treatment group consisted of 4 animals. The mice were sacrificed 72 hours following the final administration to determine the liver FXI mRNA levels using real-time PCR and RIBOGREEN® RNA quantification reagent (Molecular Probes, Inc. Eugene, Oreg.) according to standard protocols. Plasma FXI protein levels were also measured using ELISA. FXI mRNA levels were determined relative to total RNA (using RIBOGREEN®), prior to normalization to PBS-treated control. The results below are presented as the average percent of FXI mRNA levels for each treatment group. The data was normalized to PBS-treated control and is denoted as "% PBS". The ED$_{50}$s were measured using similar methods as described previously and are presented below.

TABLE 50

Factor XI mRNA (% Saline)

| ASO | Dose mg/kg | % Control | Conjugate | Linkages |
|---|---|---|---|---|
| Saline | | 100 | none | |
| ISIS 404071 | 3<br>10<br>30 | 92<br>40<br>15 | none | PS |
| ISIS 656172 | 0.7<br>2<br>6 | 74<br>33<br>9 | GalNAc$_3$-1 | PS |
| ISIS 656173 | 0.7<br>2<br>6 | 49<br>22<br>1 | GalNAc$_3$-1 | PO/PS |

As illustrated in Table 50, treatment with antisense oligonucleotides lowered FXI mRNA levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

As illustrated in Table 50a, treatment with antisense oligonucleotides lowered FXI protein levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

TABLE 50a

Factor XI protein (% Saline)

| ASO | Dose mg/kg | Protein (% Control) | Conjugate | Linkages |
|---|---|---|---|---|
| Saline |  | 100 | none |  |
| ISIS 404071 | 3 | 127 | none | PS |
|  | 10 | 32 |  |  |
|  | 30 | 3 |  |  |
| ISIS 656172 | 0.7 | 70 | GalNAc$_3$-1 | PS |
|  | 2 | 23 |  |  |
|  | 6 | 1 |  |  |
| ISIS 656173 | 0.7 | 45 | GalNAc$_3$-1 | PO/PS |
|  | 2 | 6 |  |  |
|  | 6 | 0 |  |  |

Liver transaminase levels, alanine aminotransferase (ALT) and aspartate aminotransferase (AST), in serum were measured relative to saline injected mice using standard protocols. Total bilirubin, total albumin, CRE and BUN were also evaluated. The change in body weights was evaluated with no significant change from the saline group. ALTs, ASTs, total bilirubin and BUN values are shown in the table below.

TABLE 51

| ISIS No. | Dosage mg/kg | ALT | AST | Total Albumin | Total Bilirubin | CRE | BUN | Conjugate |
|---|---|---|---|---|---|---|---|---|
| Saline |  | 71.8 | 84.0 | 3.1 | 0.2 | 0.2 | 22.9 |  |
| 404071 | 3 | 152.8 | 176.0 | 3.1 | 0.3 | 0.2 | 23.0 | none |
|  | 10 | 73.3 | 121.5 | 3.0 | 0.2 | 0.2 | 21.4 |  |
|  | 30 | 82.5 | 92.3 | 3.0 | 0.2 | 0.2 | 23.0 |  |
| 656172 | 0.7 | 62.5 | 111.5 | 3.1 | 0.2 | 0.2 | 23.8 | GalNAc$_3$-1 (3') |
|  | 2 | 33.0 | 51.8 | 2.9 | 0.2 | 0.2 | 22.0 |  |
|  | 6 | 65.0 | 71.5 | 3.2 | 0.2 | 0.2 | 23.9 |  |
| 656173 | 0.7 | 54.8 | 90.5 | 3.0 | 0.2 | 0.2 | 24.9 | GalNAc$_3$-1 (3') |
|  | 2 | 85.8 | 71.5 | 3.2 | 0.2 | 0.2 | 21.0 |  |
|  | 6 | 114.0 | 101.8 | 3.3 | 0.2 | 0.2 | 22.7 |  |

Example 60

Effects of Conjugated ASOs Targeting SRB-1 In Vitro

The oligonucleotides listed below were tested in a multiple dose study for antisense inhibition of SRB-1 in primary mouse hepatocytes. ISIS 353382 was included as an unconjugated standard. Each of the conjugate groups were attached at the 3' or 5' terminus of the respective oligonucleotide by a phosphodiester linked 2'-deoxyadenosine nucleoside cleavable moiety.

TABLE 52

Modified ASO targeting SRB-1

| ASO | Sequence (5' to 3') | Motif | Conjugate | SEQ ID No. |
|---|---|---|---|---|
| ISIS 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | none | 108 |
| ISIS 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$,-GalNAC$_3$-1$_a$ | 5/10/5 | GalNAc$_3$-1 | 110 |
| ISIS 655862 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$T$_{es}$T$_{eo}$A$_{do}$,-GalNAC$_3$-1$_a$ | 5/10/5 | GalNAc$_3$-1 | 110 |
| ISIS 661161 | GalNAc$_3$-3$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc$_3$-3 | 109 |
| ISIS 665001 | GalNAC$_3$-8$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc$_3$-8 | 109 |
| ISIS 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$,-GalNAC$_3$-9$_a$ | 5/10/5 | GalNAc$_3$-9 | 110 |
| ISIS 666961 | GalNAc$_3$-6$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc$_3$-6 | 109 |
| ISIS 664507 | GalNAc$_3$-2$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc$_3$-2 | 109 |
| ISIS 666881 | GalNAc$_3$-10$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc$_3$-10 | 109 |
| ISIS 666224 | GalNAc$_3$-5$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc$_3$-5 | 109 |

TABLE 52 -continued

Modified ASO targeting SRB-1

| ASO | Sequence (5' to 3') | Motif | Conjugate | SEQ ID No. |
|---|---|---|---|---|
| ISIS 666981 | GalNAc$_3$-7$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-7 | 109 |

Capital letters indicate the nucleobase for each nucleoside and $^m$C indicates a 5-methyl cytosine.
Subscripts:
"e" indicates a 2'-MOE modified nucleoside;
"d" indicates a β-D-2'-deoxyribonucleoside;
"s" indicates a phosphorothioate internucleoside linkage (PS);
"o" indicates a phosphodiester internucleoside linkage (PO);
and
"o'" indicates -O-P(=O)(OH)-.
Conjugate groups are in bold.
The structure of GalNAc$_3$-1$_a$ was shown previously in Example 9.
The structure of GalNAc$_3$-3$_a$ was shown previously in Example 39.
The structure of GalNAc$_3$-8$_a$ was shown previously in Example 47.
The structure of GalNAc$_3$-9$_a$ was shown previously in Example 52.
The structure of GalNAc$_3$-6$_a$ was shown previously in Example 51.
The structure of GalNAc$_3$-2$_a$ was shown previously in Example 37.
The structure of GalNAc$_3$-10$_a$ was shown previously in Example 46.
The structure of GalNAc$_3$-5$_a$ was shown previously in Example 49.
The structure of GalNAc$_3$-7a was shown previously in Example 48.

Treatment

The oligonucleotides listed above were tested in vitro in primary mouse hepatocyte cells plated at a density of 25,000 cells per well and treated with 0.03, 0.08, 0.24, 0.74, 2.22, 6.67 or 20 nM modified oligonucleotide. After a treatment period of approximately 16 hours, RNA was isolated from the cells and mRNA levels were measured by quantitative real-time PCR and the SRB-1 mRNA levels were adjusted according to total RNA content, as measured by RIBOGREEN®.

The IC$_{50}$ was calculated using standard methods and the results are presented in Table 53. The results show that, under free uptake conditions in which no reagents or electroporation techniques are used to artificially promote entry of the oligonucleotides into cells, the oligonucleotides comprising a GalNAc conjugate were significantly more potent in hepatocytes than the parent oligonucleotide (ISIS 353382) that does not comprise a GalNAc conjugate.

TABLE 53

| ASO | IC50 (nM) | Internucleoside linkages | Conjugate | SEQ ID No. |
|---|---|---|---|---|
| ISIS 353382 | 190$^a$ | PS | none | 108 |
| ISIS 655861 | 11$^a$ | PS | GalNAc$_3$-1 | 110 |

TABLE 53-continued

| ASO | IC50 (nM) | Internucleoside linkages | Conjugate | SEQ ID No. |
|---|---|---|---|---|
| ISIS 655862 | 3 | PO/PS | GalNAc$_3$-1 | 110 |
| ISIS 661161 | 15$^a$ | PS | GalNAc$_3$-3 | 109 |
| ISIS 665001 | 20 | PS | GalNAc$_3$-8 | 109 |
| ISIS 664078 | 55 | PS | GalNAc$_3$-9 | 110 |
| ISIS 666961 | 22$^a$ | PS | GalNAc$_3$-6 | 109 |
| ISIS 664507 | 30 | PS | GalNAc$_3$-2 | 109 |
| ISIS 666881 | 30 | PS | GalNAc$_3$-10 | 109 |
| ISIS 666224 | 30$^a$ | PS | GalNAc$_3$-5 | 109 |
| ISIS 666981 | 40 | PS | GalNAc$_3$-7 | 109 |

$^a$Average of multiple runs.

Example 61

Preparation of Oligomeric Compound 175 Comprising GalNAc$_3$-12

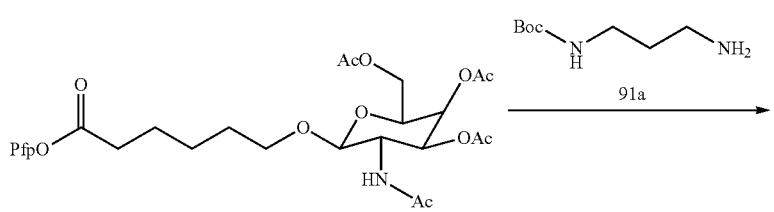

166

-continued
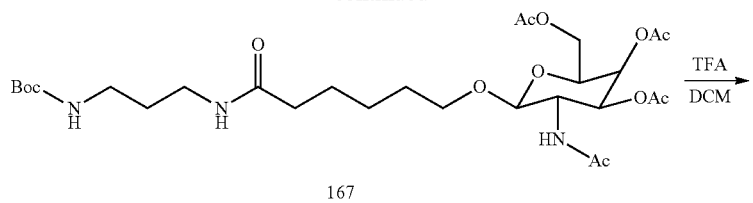
167
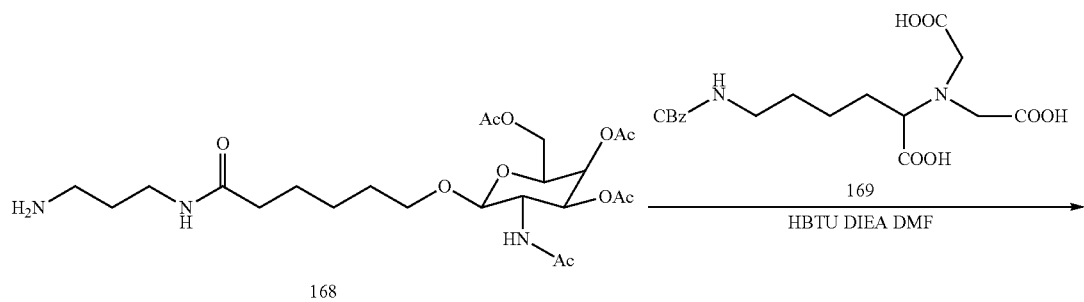
168
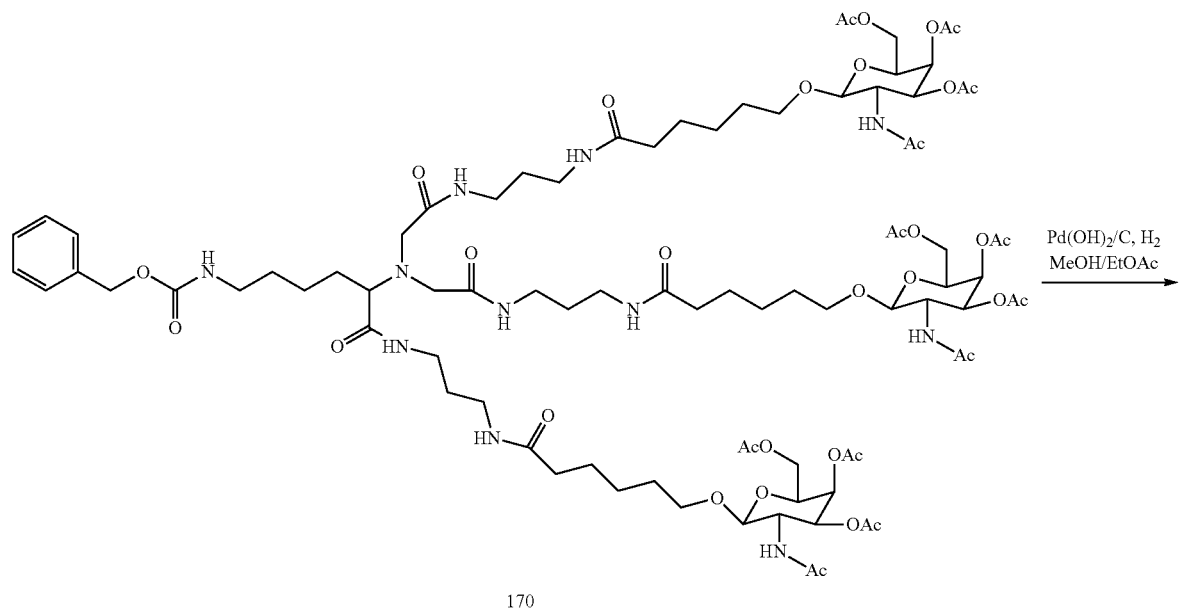
170
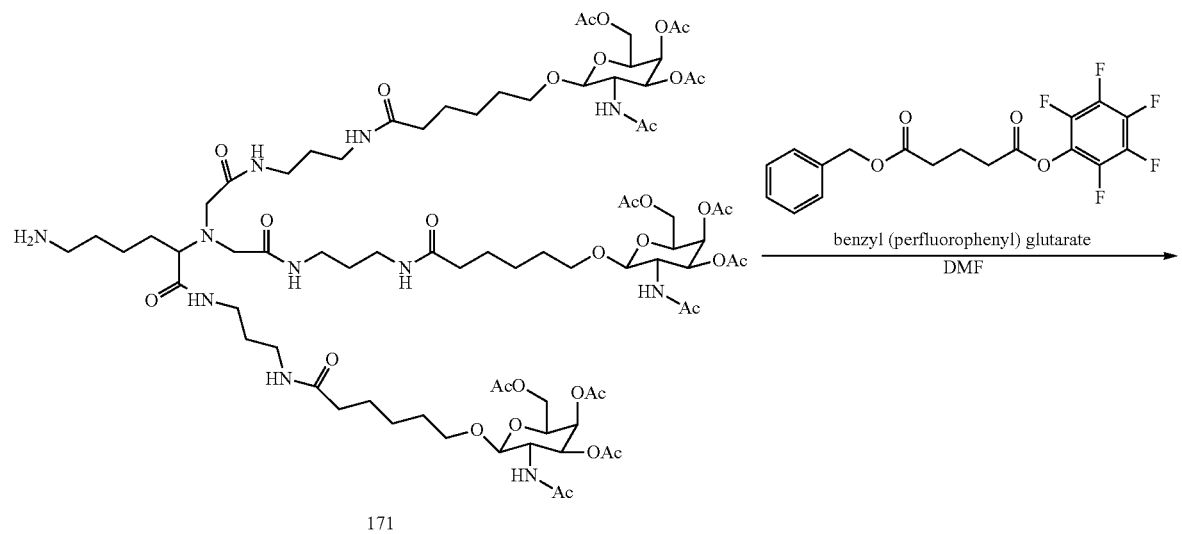
171

831 832
-continued
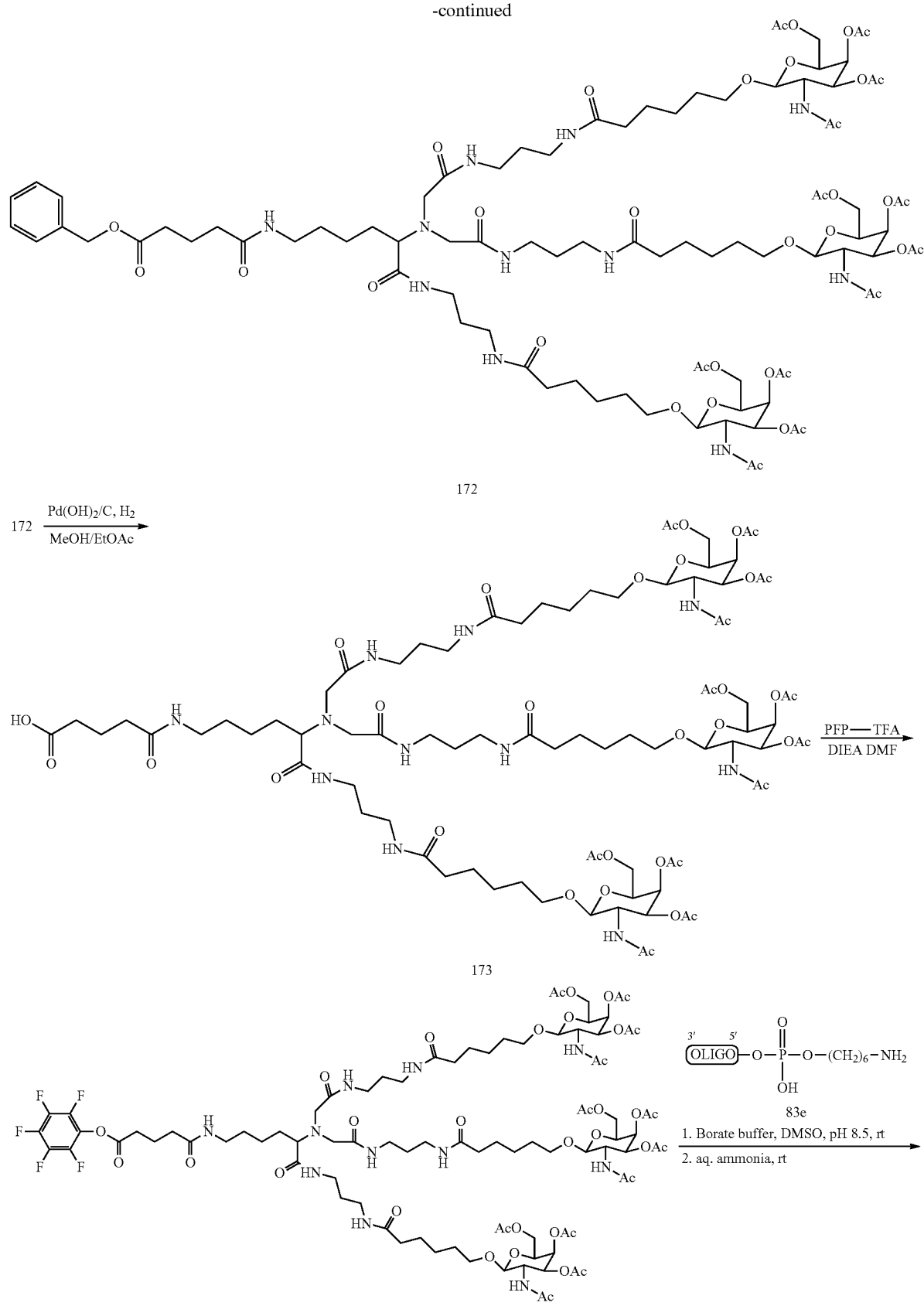
172
173
174

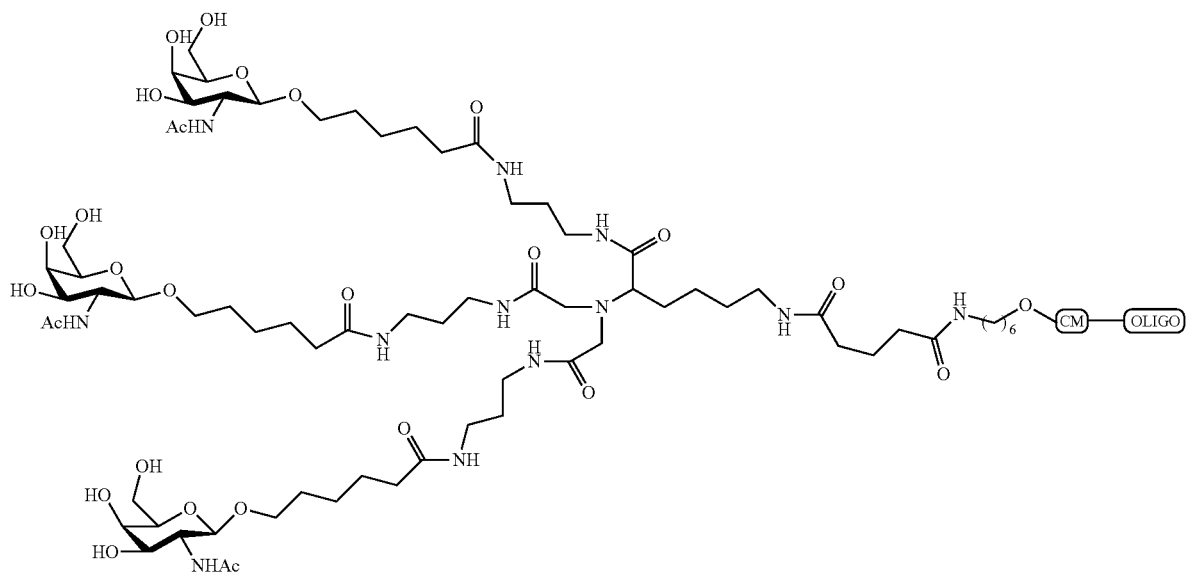

175

Compound 169 is commercially available. Compound 172 was prepared by addition of benzyl(perfluorophenyl)glutarate to compound 171. The benzyl(perfluorophenyl)glutarate was prepared by adding PFP-TFA and DIEA to 5-(benzyloxy)-5-oxopentanoic acid in DMF. Oligomeric compound 175, comprising a GalNAc$_3$-12 conjugate group, was prepared from compound 174 using the general procedures illustrated in Example 46. The GalNAc$_3$ cluster portion of the conjugate group GalNAc$_3$-12 (GalNAc$_3$-12$_a$) can be combined with any cleavable moiety to provide a variety of conjugate groups. In a certain embodiments, the cleavable moiety is —P(=O)(OH)-A$_d$-P(=O)(OH)—. The structure of GalNAc$_3$-12 (GalNAc$_3$-12$_a$-CM-) is shown below:

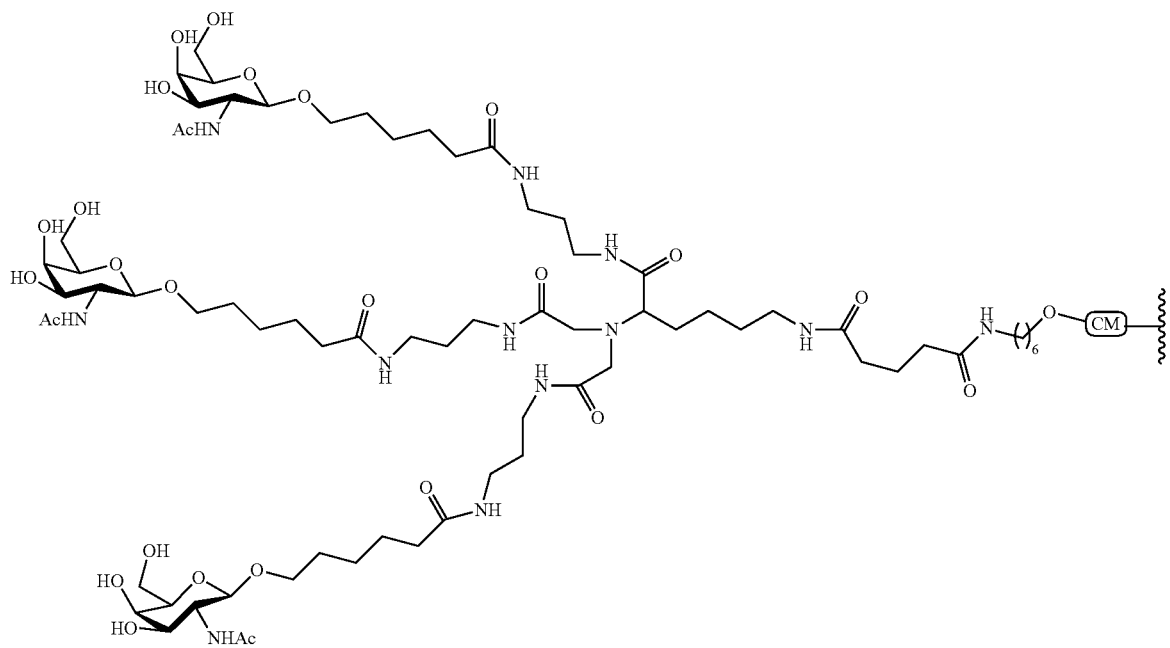

Example 62
Preparation of Oligomeric Compound 180
Comprising GalNAc$_3$-13
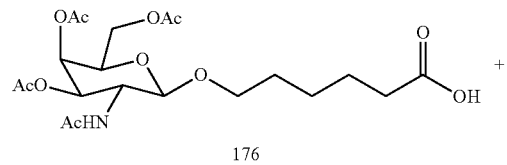
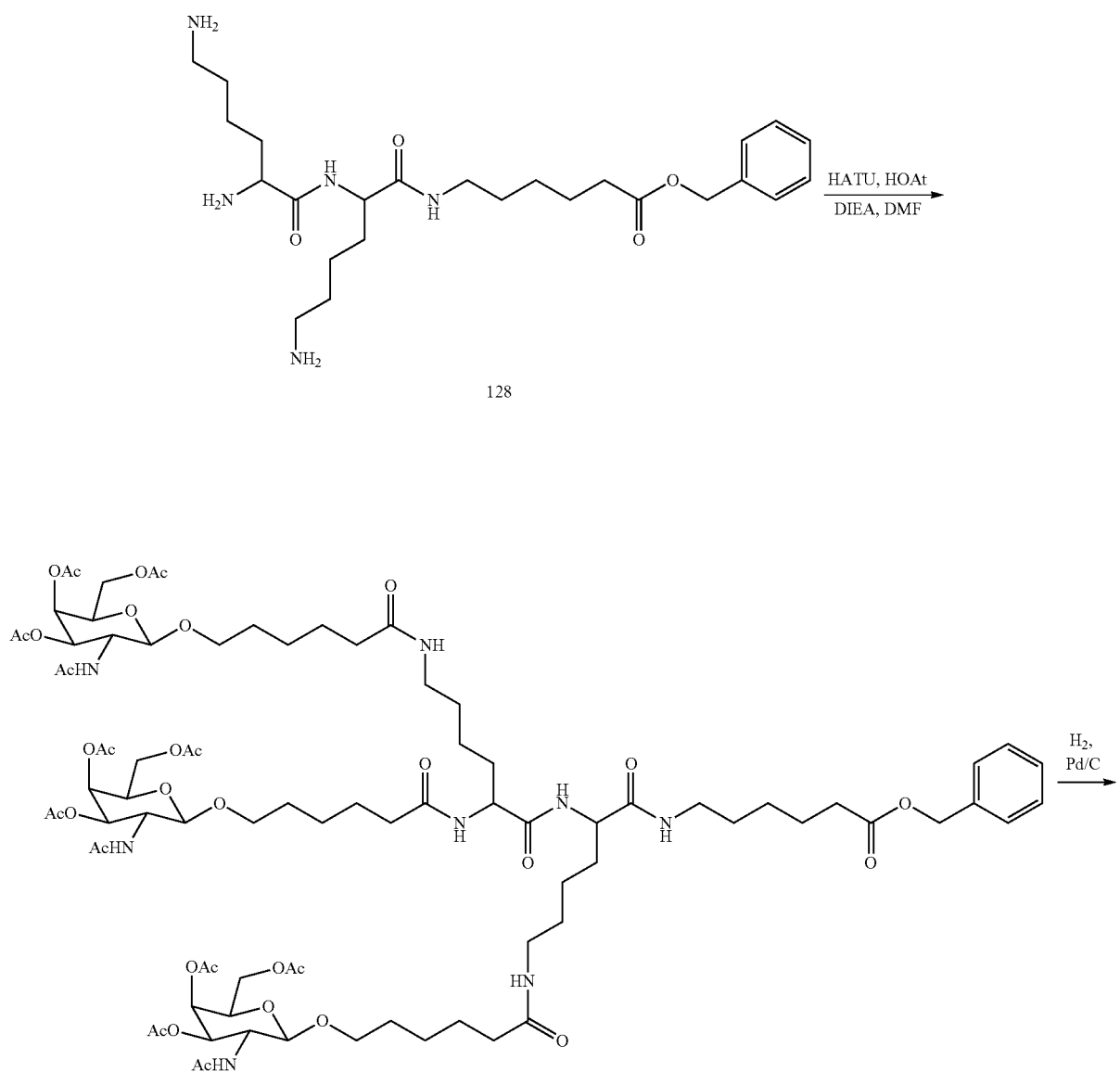

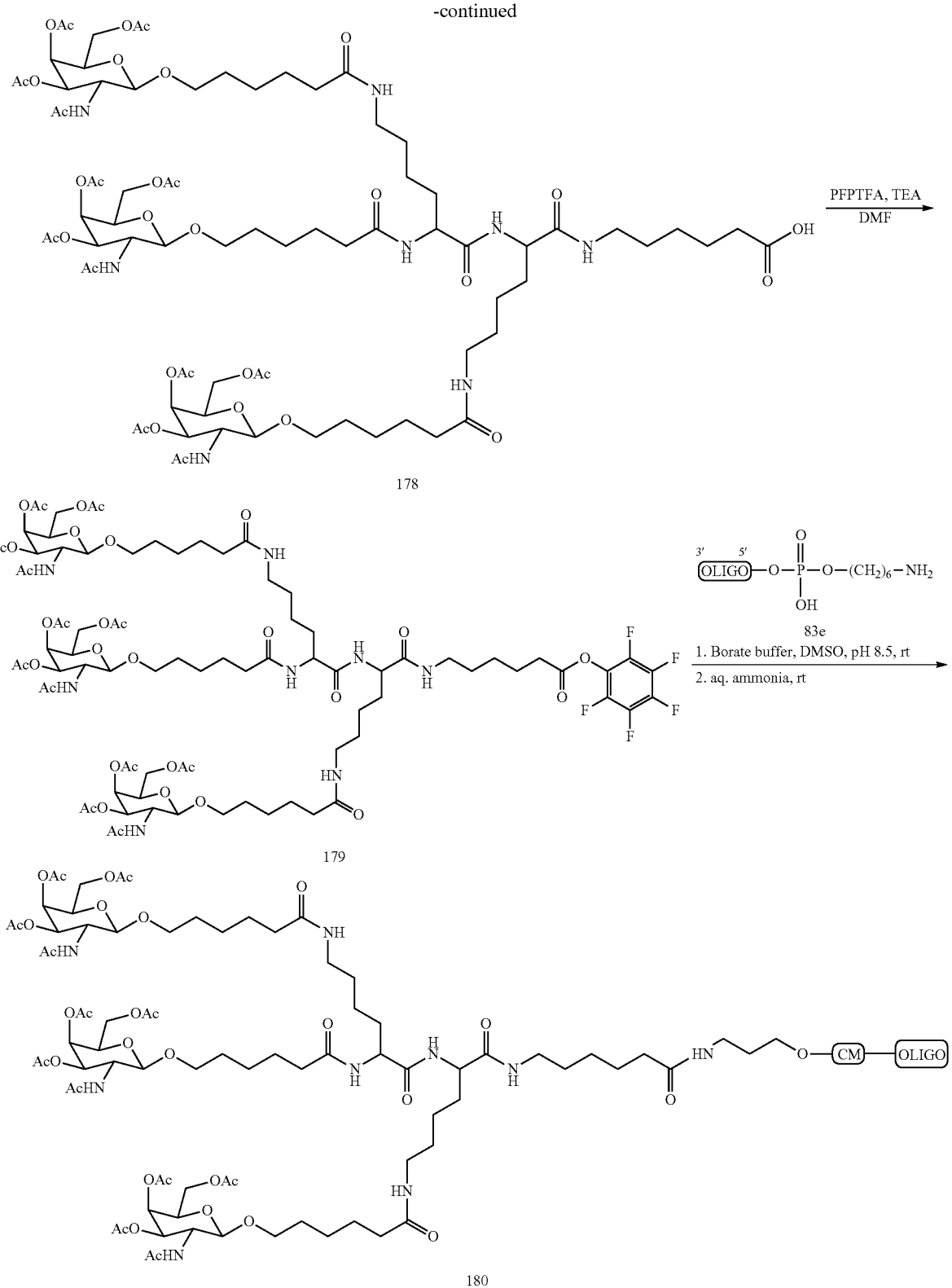

Compound 176 was prepared using the general procedure shown in Example 2. Oligomeric compound 180, comprising a GalNAc₃-13 conjugate group, was prepared from compound 177 using the general procedures illustrated in Example 49. The GalNAc₃ cluster portion of the conjugate group GalNAc₃-13 (GalNAc₃-13$_a$) can be combined with any cleavable moiety to provide a variety of conjugate groups. In a certain embodiments, the cleavable moiety is —P(=O)(OH)-A$_d$-P(=O)(OH)—. The structure of GalNAc₃-13 (GalNAc₃-13$_a$-CM-) is shown below:

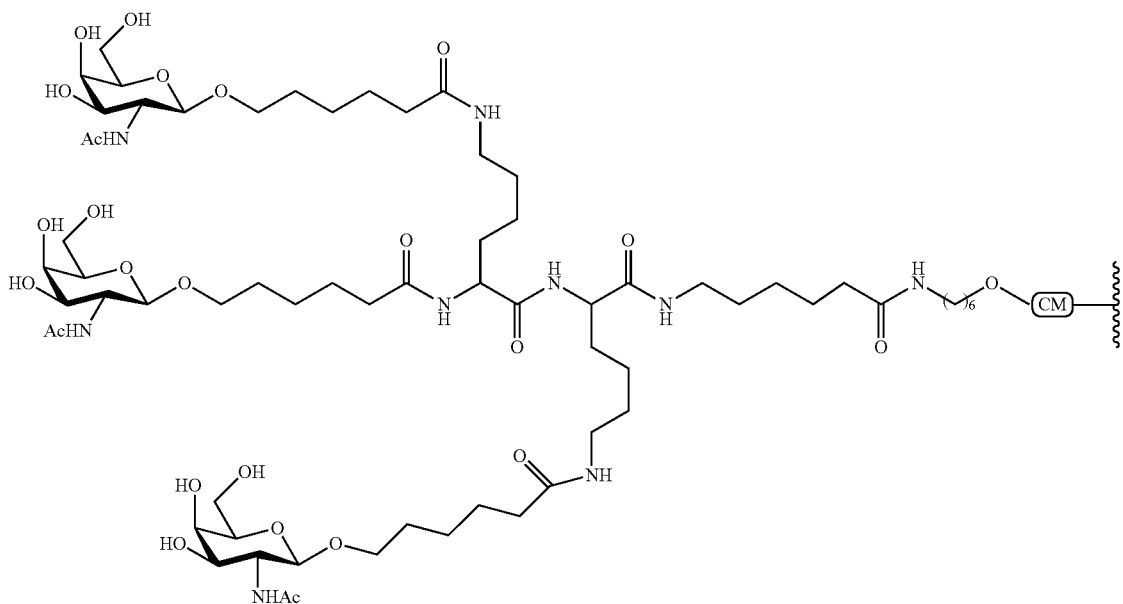
Example 63
Preparation of Oligomeric Compound 188
Comprising GalNAc₃-14
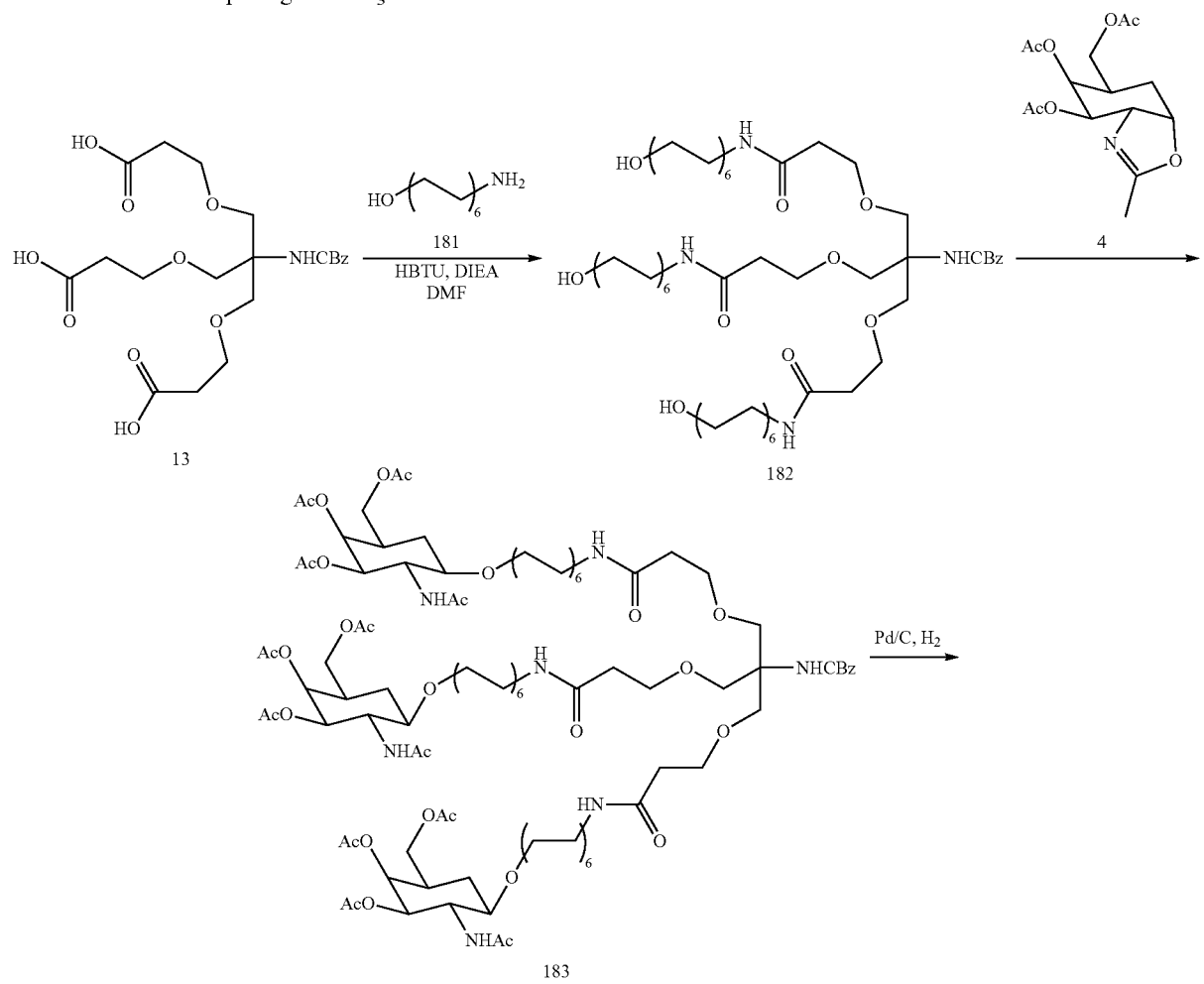

-continued
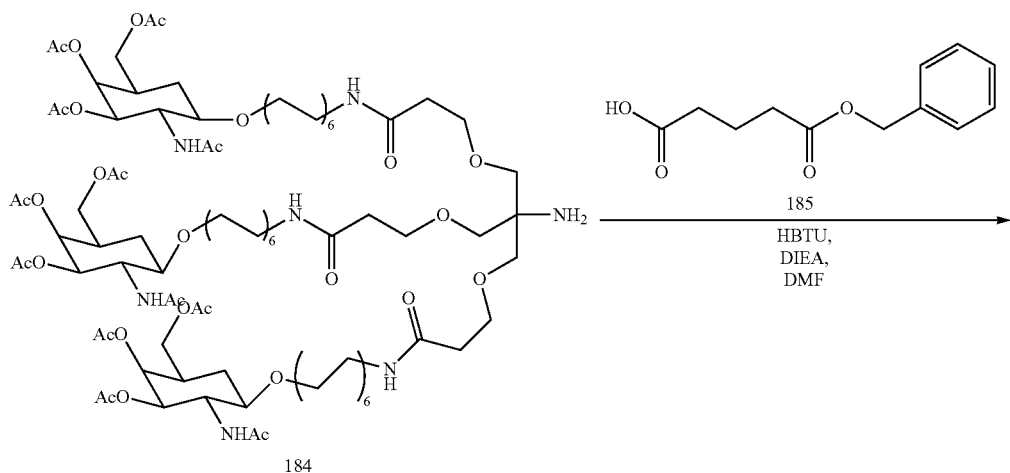
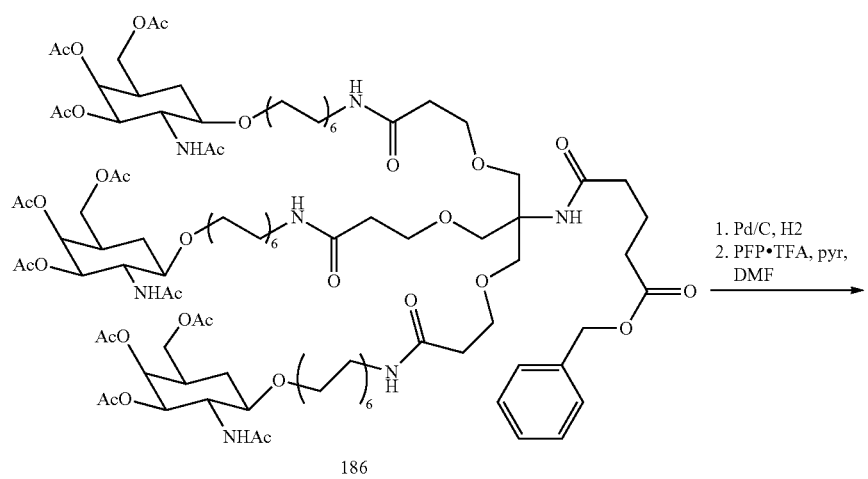
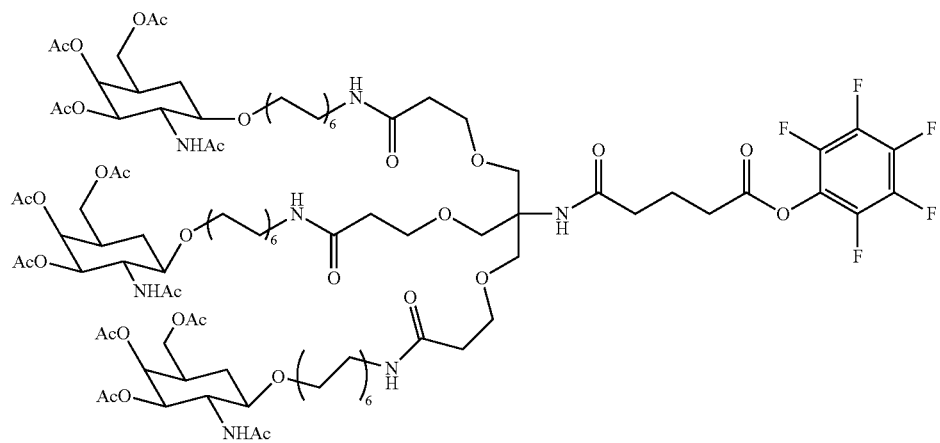

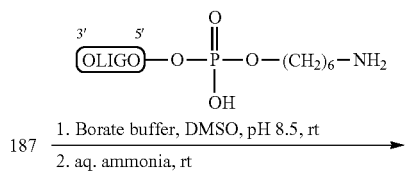

187 $\xrightarrow{\text{1. Borate buffer, DMSO, pH 8.5, rt}}_{\text{2. aq. ammonia, rt}}$

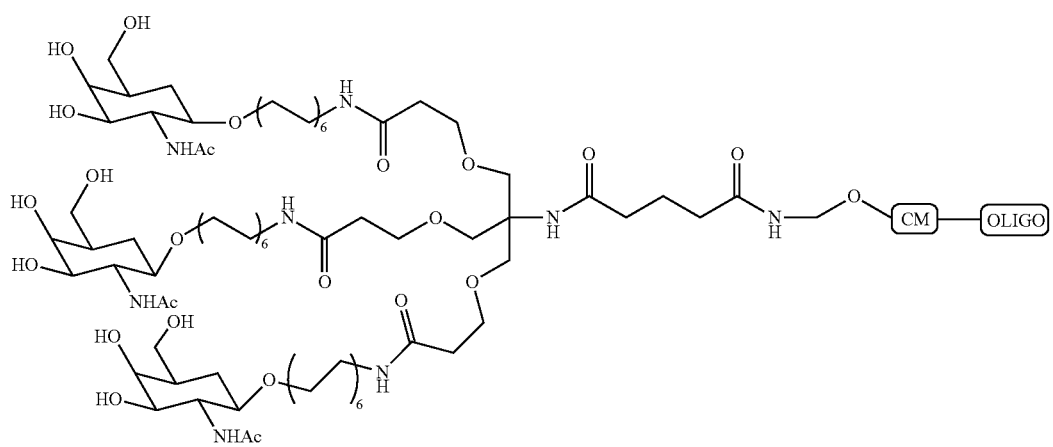

188

Compounds 181 and 185 are commercially available. Oligomeric compound 188, comprising a GalNAc$_3$-14 conjugate group, was prepared from compound 187 using the general procedures illustrated in Example 46. The GalNAc$_3$ cluster portion of the conjugate group GalNAc$_3$-14 (GalNAc$_3$-14$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-14 (GalNAc$_3$-14$_a$-CM-) is shown below:

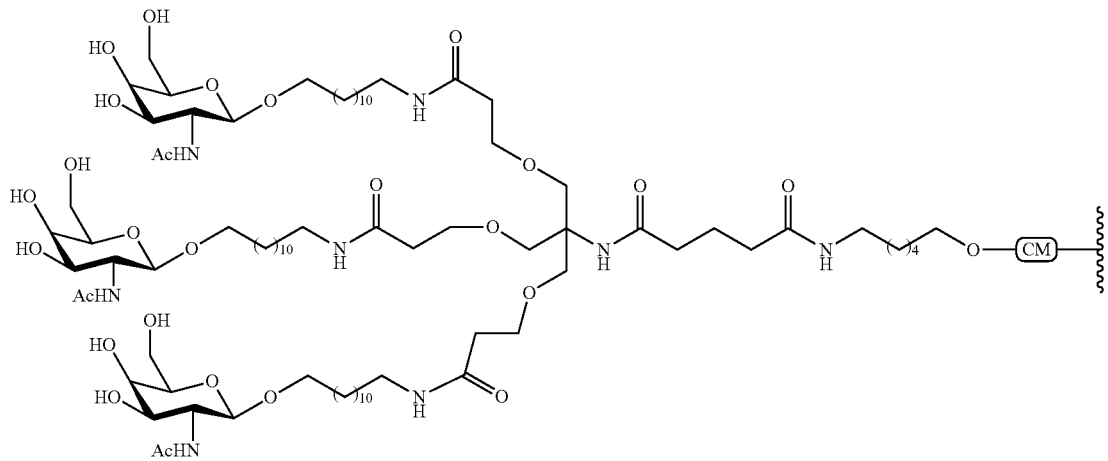

Example 64
Preparation of Oligomeric Compound 197 Comprising GalNAc$_3$-15
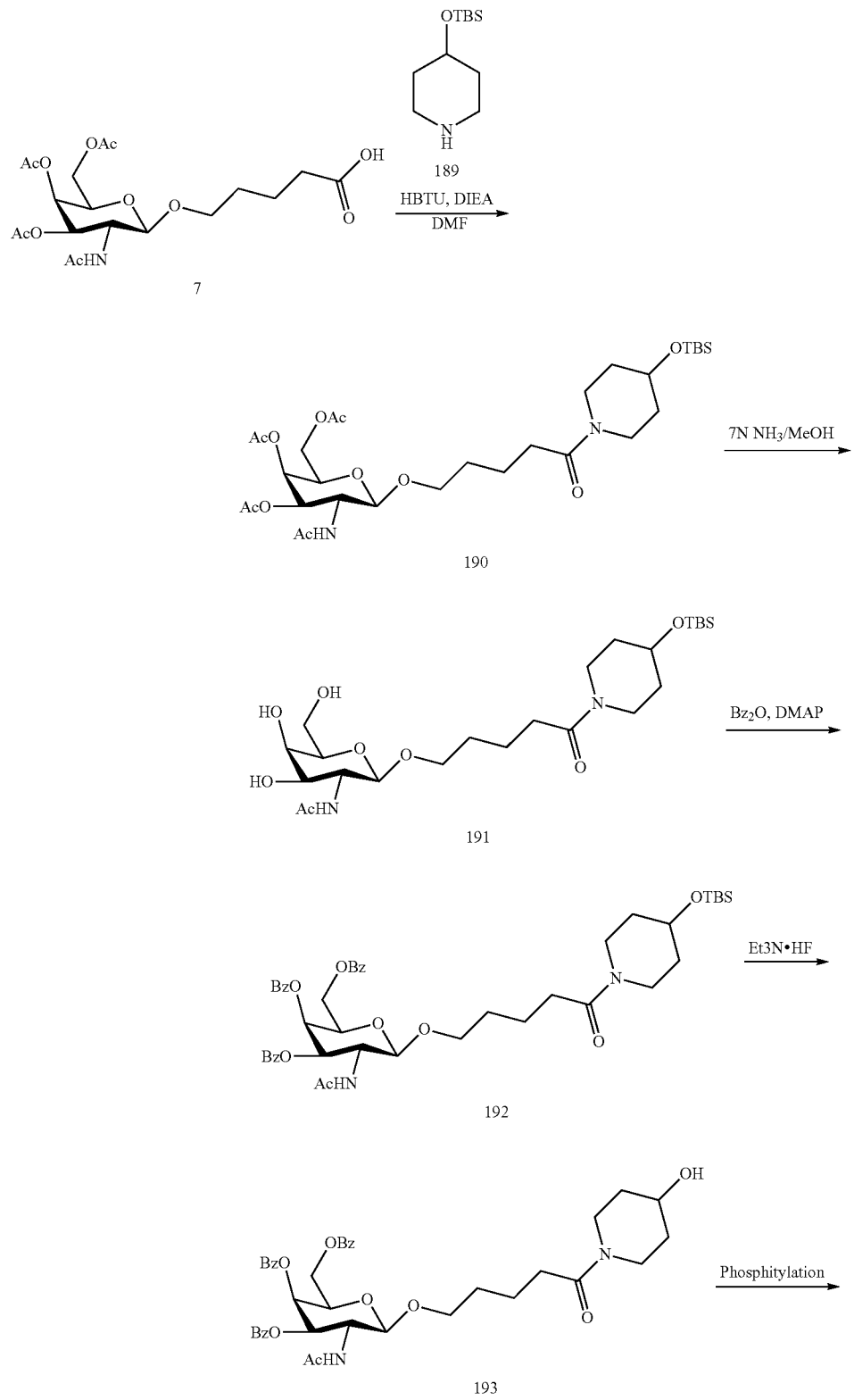

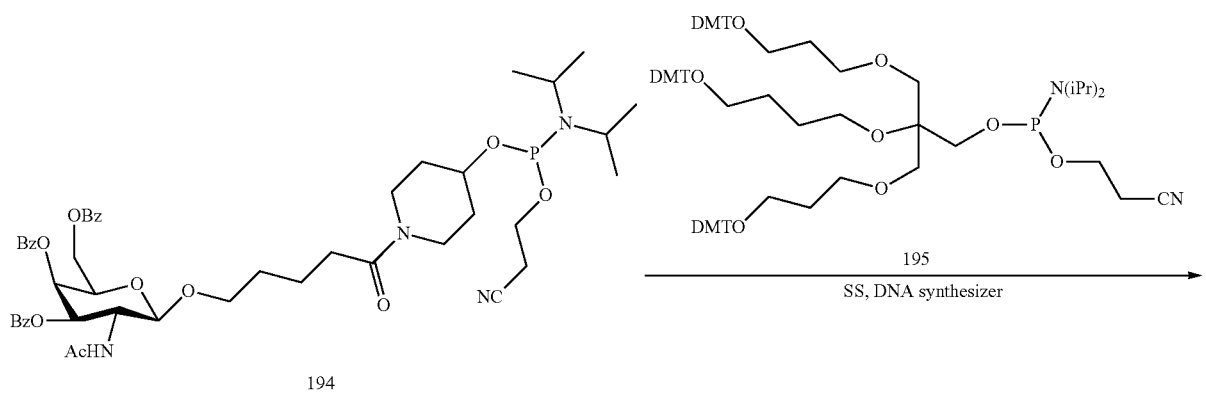

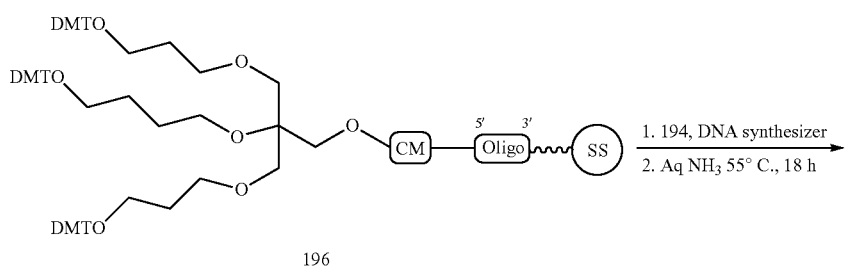

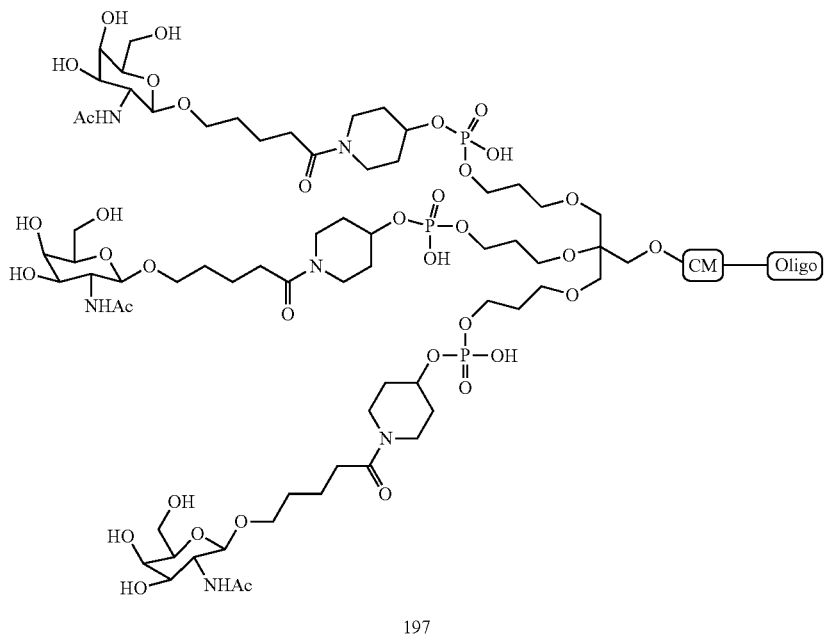

Compound 189 is commercially available. Compound 195 was prepared using the general procedure shown in Example 31. Oligomeric compound 197, comprising a GalNAc$_3$-15 conjugate group, was prepared from compounds 194 and 195 using standard oligonucleotide synthesis procedures. The GalNAc$_3$ cluster portion of the conjugate group GalNAc$_3$-15 (GalNAc$_3$-15$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-15 (GalNAc$_3$-15$_a$-CM-) is shown below:

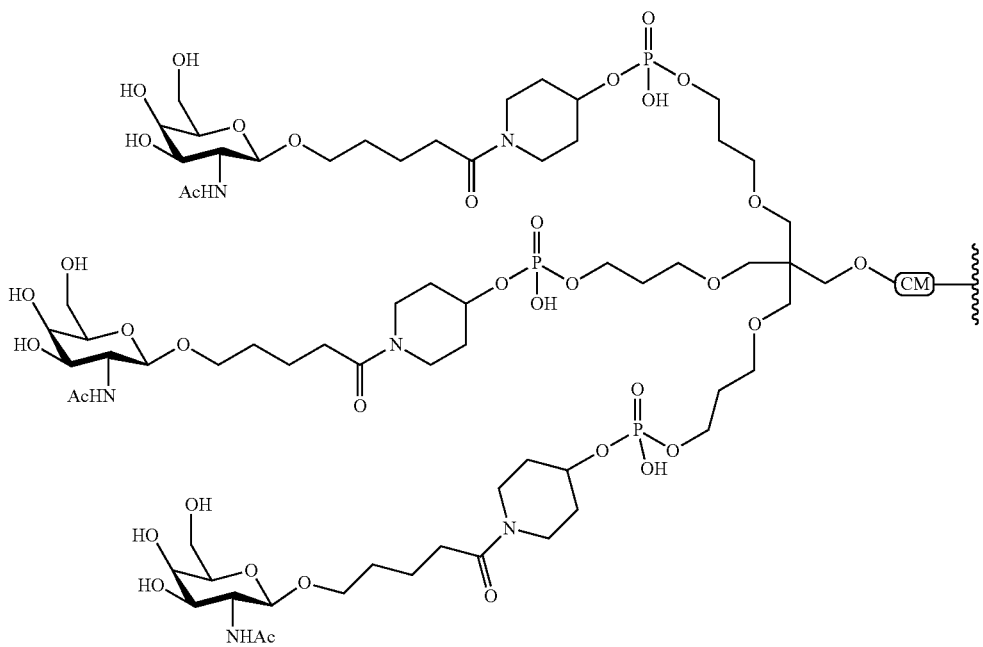

Example 65

Dose-Dependent Study of Oligonucleotides Comprising a 5'-Conjugate Group (Comparison of GalNAc$_3$-3, 12, 13, 14, and 15) Targeting SRB-1 In Vivo The oligonucleotides listed below were tested in a dose-dependent study for antisense inhibition of SRB-1 in mice. Unconjugated ISIS 353382 was included as a standard. Each of the GalNAc$_3$ conjugate groups was attached at the 5' terminus of the respective oligonucleotide by a phosphodiester linked 2'-deoxyadenosine nucleoside (cleavable moiety).

TABLE 54

Modified ASOs targeting SRB-1

| ISIS No. | Sequences (5' to 3') | Conjugate | SEQ ID No. |
|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{es}$$^m$C$_{es}$$^m$C$_{es}$T$_{es}$T$_e$ | none | 108 |
| 661161 | GalNAc$_3$-3$_a$-$_o$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{es}$$^m$C$_{es}$$^m$C$_{es}$T$_{es}$T$_e$ | GalNAc$_3$-3 | 109 |
| 671144 | GalNAc$_3$-12$_a$-$_o$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{es}$$^m$C$_{es}$$^m$C$_{es}$T$_{es}$T$_e$ | GalNAc$_3$-12 | 109 |
| 670061 | GalNAc$_3$-13$_a$-$_o$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{es}$$^m$C$_{es}$$^m$C$_{es}$T$_{es}$T$_e$ | GalNAc$_3$-13 | 109 |
| 671261 | GalNAc$_3$-14$_a$-$_o$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{es}$$^m$C$_{es}$$^m$C$_{es}$T$_{es}$T$_e$ | GalNAc$_3$-14 | 109 |

TABLE 54 -continued

Modified ASOs targeting SRB-1

| ISIS No. | Sequences (5' to 3') | Conjugate | SEQ ID No. |
|---|---|---|---|
| 671262 | GalNAc$_3$-15$_a$-$_o$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{es}$$^m$C$_{es}$$^m$C$_{es}$T$_{es}$T$_e$ | GalNAc$_3$-15 | 109 |

Capital letters indicate the nucleobase for each nucleoside and $^m$C indicates a 5-methyl cytosine.
Subscripts:
"e" indicates a 2'-MOE modified nucleoside;
"d" indicates a β-D-2'-deoxyribonucleoside;
"s" indicates a phosphorothioate internucleoside linkage (PS);
"o" indicates a phosphodiester internucleoside linkage (PO); and
"o" indicates -O-P(=O)(OH)-.
Conjugate groups are in bold.
The structure of GalNAc$_3$-3$_a$ was shown previously in Example 39.
The structure of GalNAc$_3$-12$_a$ was shown previously in Example 61.
The structure of GalNAc$_3$-13$_a$ was shown previously in Example 62.
The structure of GalNAc$_3$-14$_a$ was shown previously in Example 63.
The structure of GalNAc$_3$-15$_a$ was shown previously in Example 64.

Treatment

Six to eight week old C57bl6 mice (Jackson Laboratory, Bar Harbor, Me.) were injected subcutaneously once or twice at the dosage shown below with ISIS 353382, 661161, 671144, 670061, 671261, 671262, or with saline. Mice that were dosed twice received the second dose three days after the first dose. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 55, treatment with antisense oligonucleotides lowered SRB-1 mRNA levels in a dose-dependent manner. No significant differences in target knockdown were observed between animals that received a single dose and animals that received two doses (see ISIS 353382 dosages 30 and 2×15 mg/kg; and ISIS 661161 dosages 5 and 2×2.5 mg/kg). The antisense oligonucleotides comprising the phosphodiester linked GalNAc$_3$-3, 12, 13, 14, and 15 conjugates showed substantial improvement in potency compared to the unconjugated antisense oligonucleotide (ISIS 335382).

TABLE 55

SRB-1 mRNA (% Saline)

| ISIS No. | Dosage (mg/kg) | SRB-1 mRNA (% Saline) | ED$_{50}$ (mg/kg) | Conjugate |
|---|---|---|---|---|
| Saline | n/a | 100.0 | n/a | n/a |
| 353382 | 3 | 85.0 | 22.4 | none |
|  | 10 | 69.2 |  |  |
|  | 30 | 34.2 |  |  |
|  | 2 × 15 | 36.0 |  |  |
| 661161 | 0.5 | 87.4 | 2.2 | GalNAc$_3$-3 |
|  | 1.5 | 59.0 |  |  |
|  | 5 | 25.6 |  |  |
|  | 2 × 2.5 | 27.5 |  |  |
|  | 15 | 17.4 |  |  |
| 671144 | 0.5 | 101.2 | 3.4 | GalNAc$_3$-12 |
|  | 1.5 | 76.1 |  |  |
|  | 5 | 32.0 |  |  |
|  | 15 | 17.6 |  |  |
| 670061 | 0.5 | 94.8 | 2.1 | GalNAc$_3$-13 |
|  | 1.5 | 57.8 |  |  |
|  | 5 | 20.7 |  |  |
|  | 15 | 13.3 |  |  |
| 671261 | 0.5 | 110.7 | 4.1 | GalNAc$_3$-14 |
|  | 1.5 | 81.9 |  |  |
|  | 5 | 39.8 |  |  |
|  | 15 | 14.1 |  |  |
| 671262 | 0.5 | 109.4 | 9.8 | GalNAc$_3$-15 |
|  | 1.5 | 99.5 |  |  |
|  | 5 | 69.2 |  |  |
|  | 15 | 36.1 |  |  |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 56 below.

TABLE 56

| ISIS No. | Dosage (mg/kg) | ALT (U/L) | AST (U/L) | Total Bilirubin (mg/dL) | BUN (mg/dL) | Conjugate |
|---|---|---|---|---|---|---|
| Saline | n/a | 28 | 60 | 0.1 | 39 | n/a |
| 353382 | 3 | 30 | 77 | 0.2 | 36 | none |
|  | 10 | 25 | 78 | 0.2 | 36 |  |
|  | 30 | 28 | 62 | 0.2 | 35 |  |
|  | 2 × 15 | 22 | 59 | 0.2 | 33 |  |
| 661161 | 0.5 | 39 | 72 | 0.2 | 34 | GalNAc$_3$-3 |
|  | 1.5 | 26 | 50 | 0.2 | 33 |  |
|  | 5 | 41 | 80 | 0.2 | 32 |  |
|  | 2 × 2.5 | 24 | 72 | 0.2 | 28 |  |
|  | 15 | 32 | 69 | 0.2 | 36 |  |
| 671144 | 0.5 | 25 | 39 | 0.2 | 34 | GalNAc$_3$-12 |
|  | 1.5 | 26 | 55 | 0.2 | 28 |  |
|  | 5 | 48 | 82 | 0.2 | 34 |  |
|  | 15 | 23 | 46 | 0.2 | 32 |  |
| 670061 | 0.5 | 27 | 53 | 0.2 | 33 | GalNAc$_3$-13 |
|  | 1.5 | 24 | 45 | 0.2 | 35 |  |
|  | 5 | 23 | 58 | 0.1 | 34 |  |
|  | 15 | 24 | 72 | 0.1 | 31 |  |
| 671261 | 0.5 | 69 | 99 | 0.1 | 33 | GalNAc$_3$-14 |
|  | 1.5 | 34 | 62 | 0.1 | 33 |  |
|  | 5 | 43 | 73 | 0.1 | 32 |  |
|  | 15 | 32 | 53 | 0.2 | 30 |  |
| 671262 | 0.5 | 24 | 51 | 0.2 | 29 | GalNAc$_3$-15 |
|  | 1.5 | 32 | 62 | 0.1 | 31 |  |
|  | 5 | 30 | 76 | 0.2 | 32 |  |
|  | 15 | 31 | 64 | 0.1 | 32 |  |

Example 66

Effect of Various Cleavable Moieties on Antisense Inhibition In Vivo by Oligonucleotides Targeting SRB-1 Comprising a 5'-GalNAc$_3$ Cluster The oligonucleotides listed below were tested in a dose-dependent study for antisense inhibition of SRB-1 in mice. Each of the GalNAc$_3$ conjugate groups was attached at the 5' terminus of the respective oligonucleotide by a phosphodiester linked nucleoside (cleavable moiety (CM)).

TABLE 57

Modified ASOs targeting SRB-1

| ISIS No. | Sequences (5' to 3') | GalNAc$_3$ Cluster | CM | SEQ ID No. |
|---|---|---|---|---|
| 661161 | GalNAc$_3$-3$_a$-$_o$,A$_{do}$G$_{es}$$^m$C$_{es}$T$_{es}$ T$_{es}$$^m$C$_{es}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{es}$$^m$C$_{es}$$^m$C$_{es}$T$_{es}$T$_e$ | GalNAc$_3$-3a | A$_d$ | 109 |
| 670699 | GalNAc$_3$-3$_a$-$_o$,T$_{do}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_e$ | GalNAc$_3$-3a | T$_d$ | 116 |
| 670700 | GalNAc$_3$-3$_a$-$_o$,'A$_{eo}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_e$ | GalNAc$_3$-3a | A$_e$ | 109 |
| 670701 | GalNAc$_3$-3$_a$-$_o$,T$_{eo}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_e$ | GalNAc$_3$-3a | T$_e$ | 116 |
| 671165 | GalNAc$_3$-13$_a$-$_o$,A$_{do}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_e$ | GalNAc$_3$-13a | A$_d$ | 109 |

Capital letters indicate the nucleobase for each nucleoside and $^m$C indicates a 5-methyl cytosine
Subscripts:
"e" indicates a 2'-MOE modified nucleoside;
"d" indicates a β-D-2'-deoxyribonucleoside;
"s" indicates a phosphorothioate internucleoside linkage (PS);
"o" indicates a phosphodiester internucleoside linkage (PO); and
"o'" indicates —O—P(=O)(OH)—.
Conjugate groups are in bold.
The structure of GalNAc$_3$-3$_a$ was shown previously in Example 39.
The structure of GalNAc$_3$-13$_a$ was shown previously in Example 62.

Treatment

Six to eight week old C57bl6 mice (Jackson Laboratory, Bar Harbor, Me.) were injected subcutaneously once at the dosage shown below with ISIS 661161, 670699, 670700, 670701, 671165, or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 58, treatment with antisense oligonucleotides lowered SRB-1 mRNA levels in a dose-dependent manner. The antisense oligonucleotides comprising various cleavable moieties all showed similar potencies.

TABLE 58

SRB-1 mRNA (% Saline)

| ISIS No. | Dosage (mg/kg) | SRB-1 mRNA (% Saline) | GalNac$_3$ Cluster | CM |
|---|---|---|---|---|
| Saline | n/a | 100.0 | n/a | n/a |
| 661161 | 0.5 | 87.8 | GalNAc$_3$-3a | A$_d$ |
|  | 1.5 | 631.3 |  |  |
|  | 5 | 33.8 |  |  |
|  | 15 | 14.0 |  |  |
| 670699 | 0.5 | 89.4 | GalNAc$_3$-3a | T$_d$ |
|  | 1.5 | 59.4 |  |  |
|  | 5 | 31.3 |  |  |
|  | 15 | 17.1 |  |  |
| 670700 | 0.5 | 79.0 | GalNAc$_3$-3a | A$_e$ |
|  | 1.5 | 623.3 |  |  |
|  | 5 | 32.8 |  |  |
|  | 15 | 17.9 |  |  |
| 670701 | 0.5 | 79.1 | GalNAc$_3$-3a | T$_e$ |
|  | 1.5 | 59.2 |  |  |
|  | 5 | 35.8 |  |  |
|  | 15 | 17.7 |  |  |
| 671165 | 0.5 | 76.4 | GalNAc$_3$-13a | A$_d$ |
|  | 1.5 | 43.2 |  |  |
|  | 5 | 22.6 |  |  |
|  | 15 | 10.0 |  |  |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 56 below.

TABLE 59

| ISIS No. | Dosage (mg/kg) | ALT (U/L) | AST (U/L) | Total Bilirubin (mg/dL) | BUN (mg/dL) | GalNAc$_3$ Cluster | CM |
|---|---|---|---|---|---|---|---|
| Saline | n/a | 24 | 64 | 0.2 | 31 | n/a | n/a |
| 661161 | 0.5 | 25 | 64 | 0.2 | 31 | GalNAc$_3$-3a | A$_d$ |
|  | 1.5 | 24 | 50 | 0.2 | 32 |  |  |
|  | 5 | 26 | 55 | 0.2 | 28 |  |  |
|  | 15 | 27 | 52 | 0.2 | 31 |  |  |
| 670699 | 0.5 | 42 | 83 | 0.2 | 31 | GalNAc$_3$-3a | T$_d$ |
|  | 1.5 | 33 | 58 | 0.2 | 32 |  |  |
|  | 5 | 26 | 70 | 0.2 | 29 |  |  |
|  | 15 | 25 | 67 | 0.2 | 29 |  |  |
| 670700 | 0.5 | 40 | 74 | 0.2 | 27 | GalNAc$_3$-3a | A$_e$ |
|  | 1.5 | 23 | 62 | 0.2 | 27 |  |  |
|  | 5 | 24 | 49 | 0.2 | 29 |  |  |
|  | 15 | 25 | 87 | 0.1 | 25 |  |  |
| 670701 | 0.5 | 30 | 77 | 0.2 | 27 | GalNAc$_3$-3a | T$_e$ |
|  | 1.5 | 22 | 55 | 0.2 | 30 |  |  |
|  | 5 | 81 | 101 | 0.2 | 25 |  |  |
|  | 15 | 31 | 82 | 0.2 | 24 |  |  |
| 671165 | 0.5 | 44 | 84 | 0.2 | 26 | GalNAc$_3$-13a | A$_d$ |
|  | 1.5 | 47 | 71 | 0.1 | 24 |  |  |
|  | 5 | 33 | 91 | 0.2 | 26 |  |  |
|  | 15 | 33 | 56 | 0.2 | 29 |  |  |

Example 67

Preparation of Oligomeric Compound 199 Comprising GalNAc$_3$-16

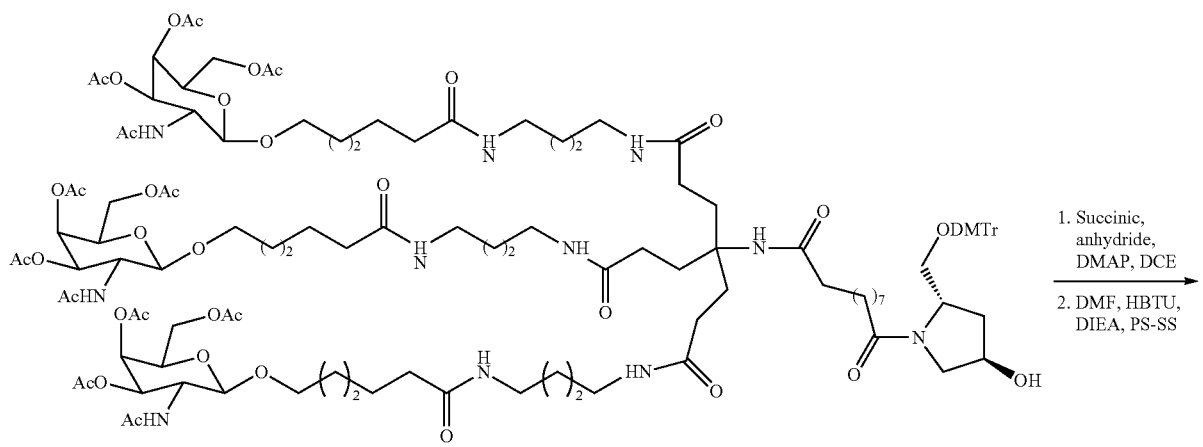

98d

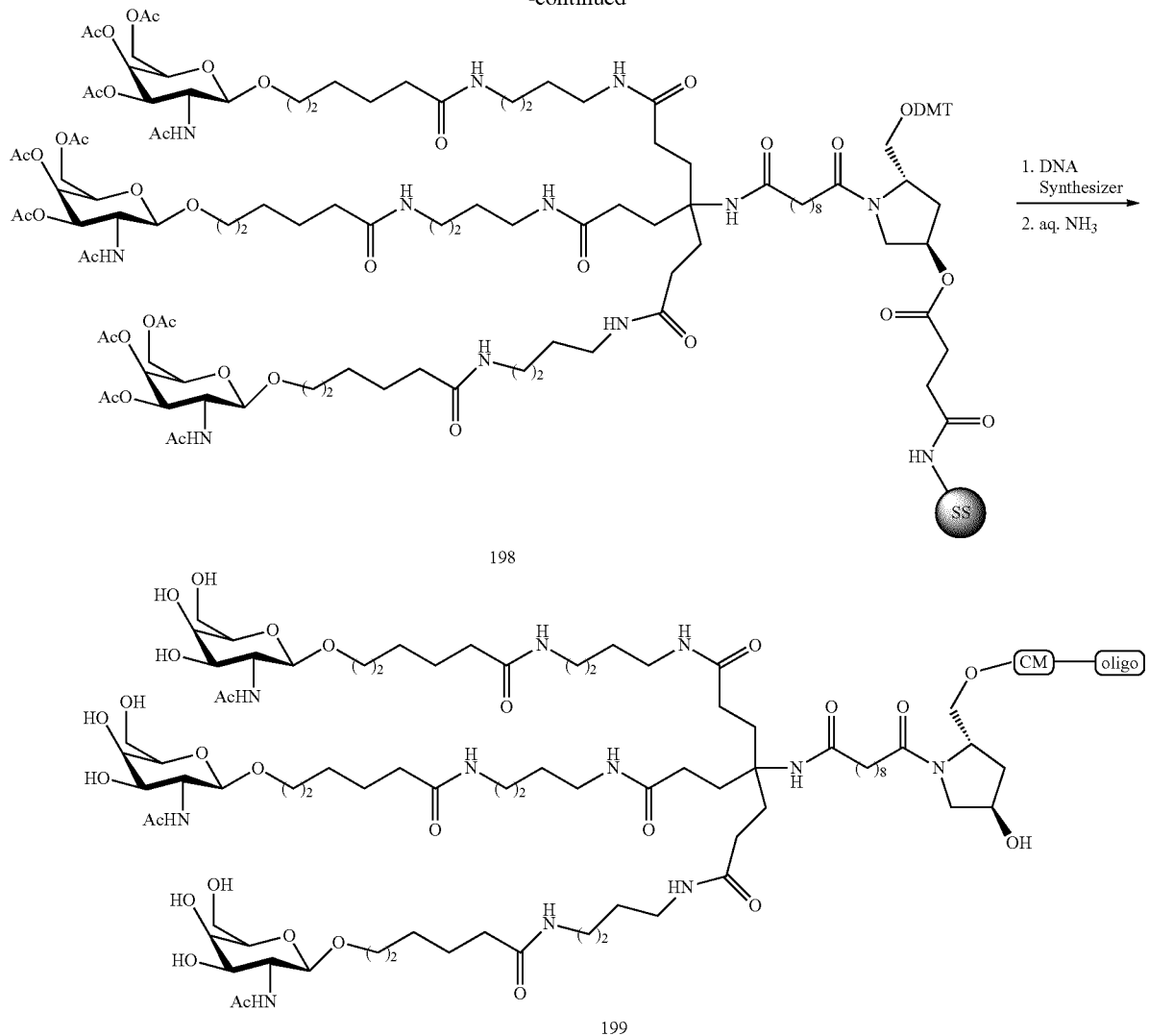

Oligomeric compound 199, comprising a GalNAc$_3$-16 conjugate group, is prepared using the general procedures illustrated in Examples 7 and 9. The GalNAc$_3$ cluster portion of the conjugate group GalNAc$_3$-16 (GalNAc$_3$-16$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-16 (GalNAc$_3$-16$_a$-CM-) is shown below:

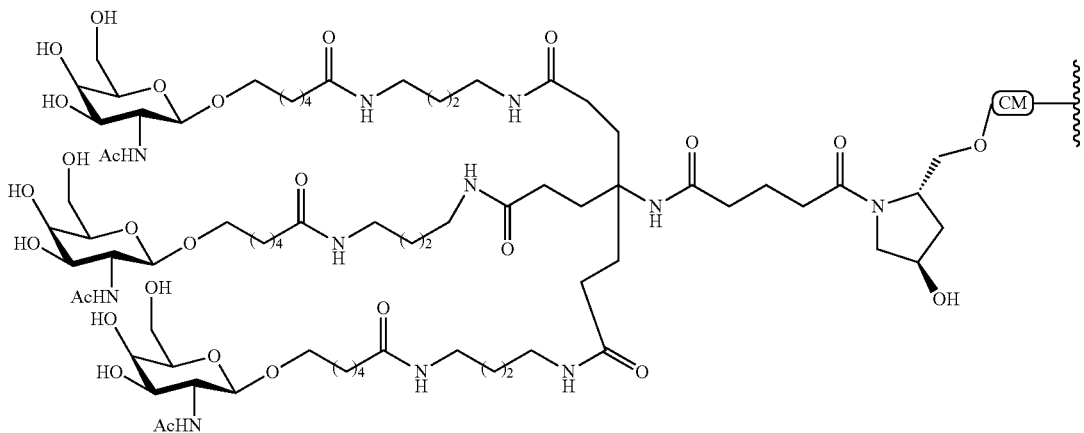

Example 68

Preparation of Oligomeric Compound 200 Comprising GalNAc₃-17

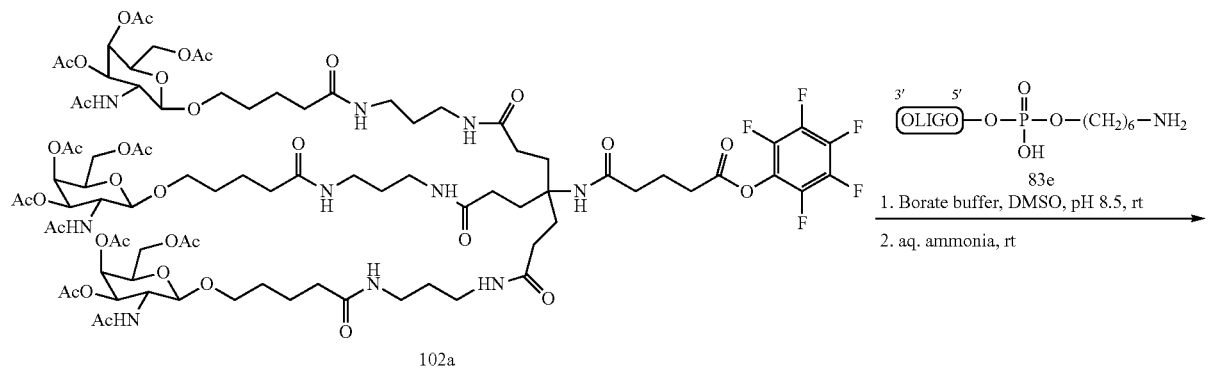

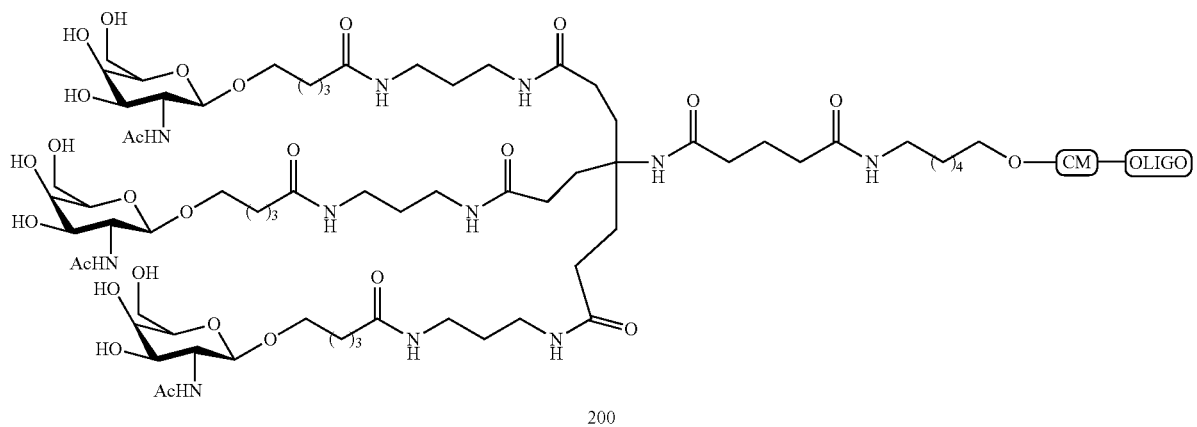

Oligomeric compound 200, comprising a GalNAc₃-17 conjugate group, was prepared using the general procedures illustrated in Example 46. The GalNAc₃ cluster portion of the conjugate group GalNAc₃-17 (GalNAc₃-17$_a$) can be combined with any cleavable moiety to provide a variety of conjugate groups. In certain embodiments, the cleavable moiety is —P(=O)(OH)-A$_d$-P(=O)(OH)—. The structure of GalNAc₃-17 (GalNAc₃-17$_a$-CM-) is shown below:

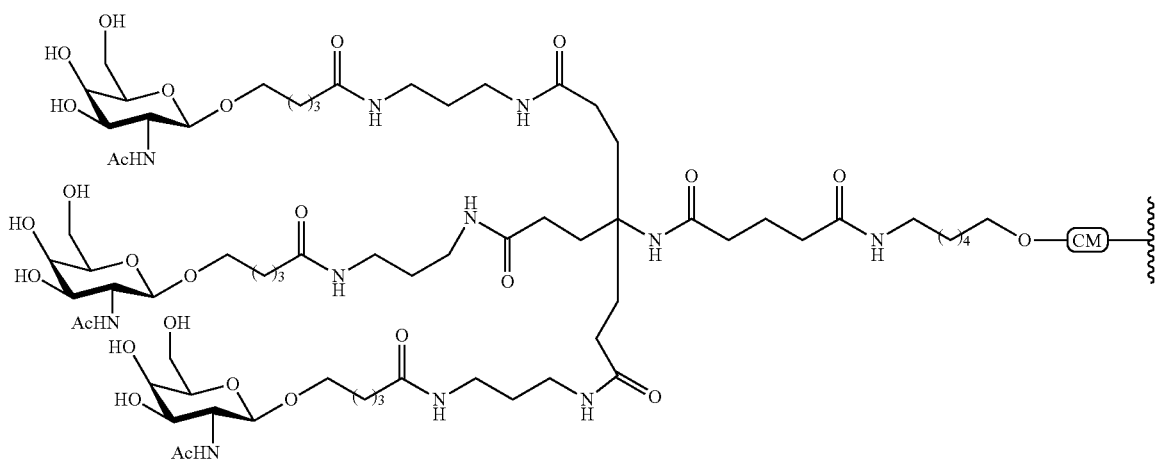

Example 69

Preparation of Oligomeric Compound 201 Comprising GalNAc₃-18

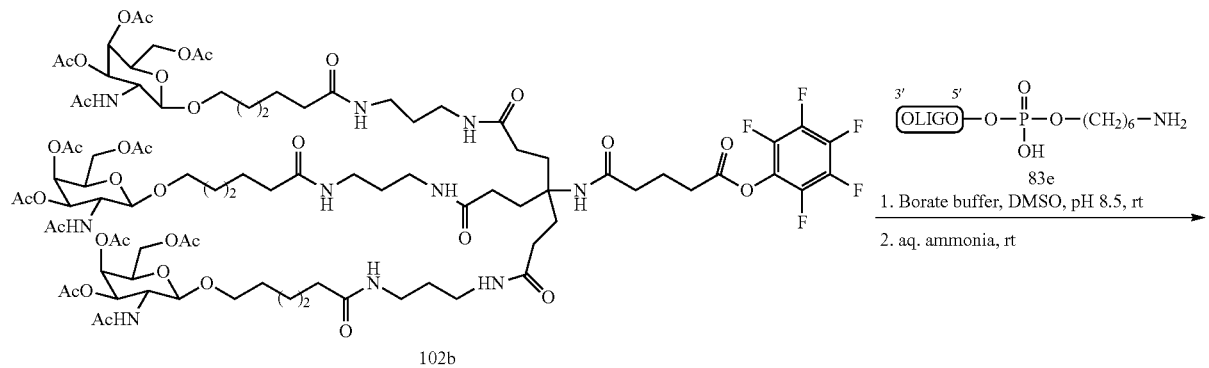

102b

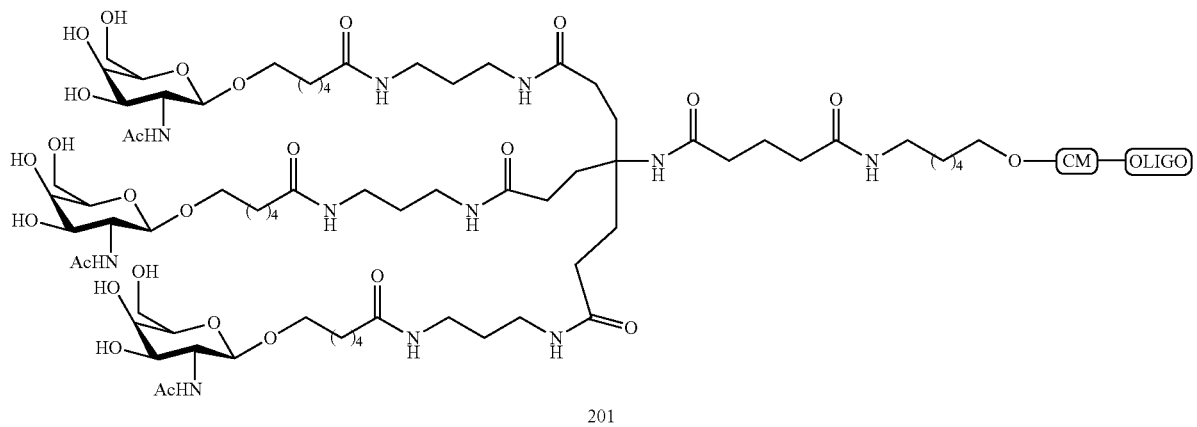

201

Oligomeric compound 201, comprising a GalNAc₃-18 conjugate group, was prepared using the general procedures illustrated in Example 46. The GalNAc₃ cluster portion of the conjugate group GalNAc₃-18 (GalNAc₃-18$_a$) can be combined with any cleavable moiety to provide a variety of conjugate groups. In certain embodiments, the cleavable moiety is —P(=O)(OH)-A$_d$-P(=O)(OH)—. The structure of GalNAc₃-18 (GalNAc₃-18$_a$-CM-) is shown below:

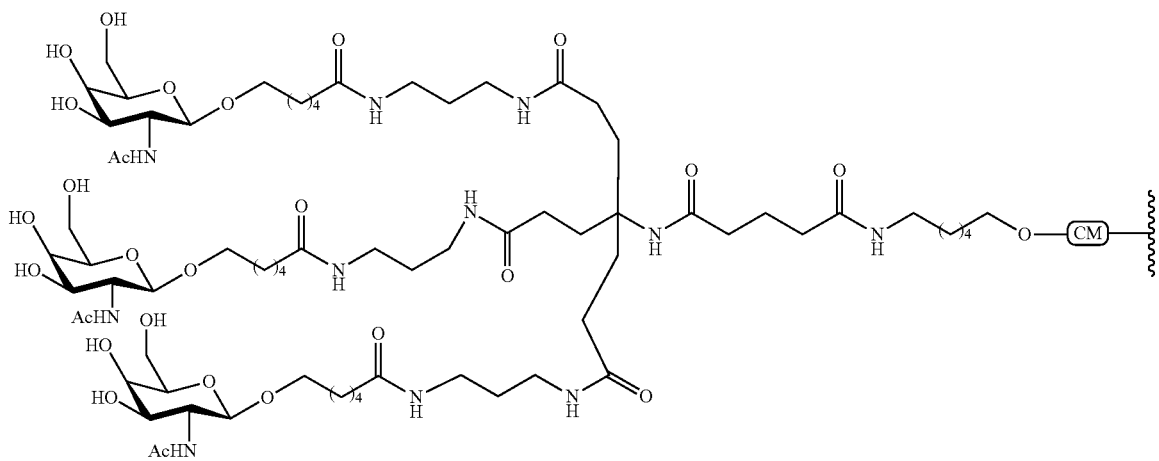

Example 70

Preparation of Oligomeric Compound 204
Comprising GalNAc₃-19

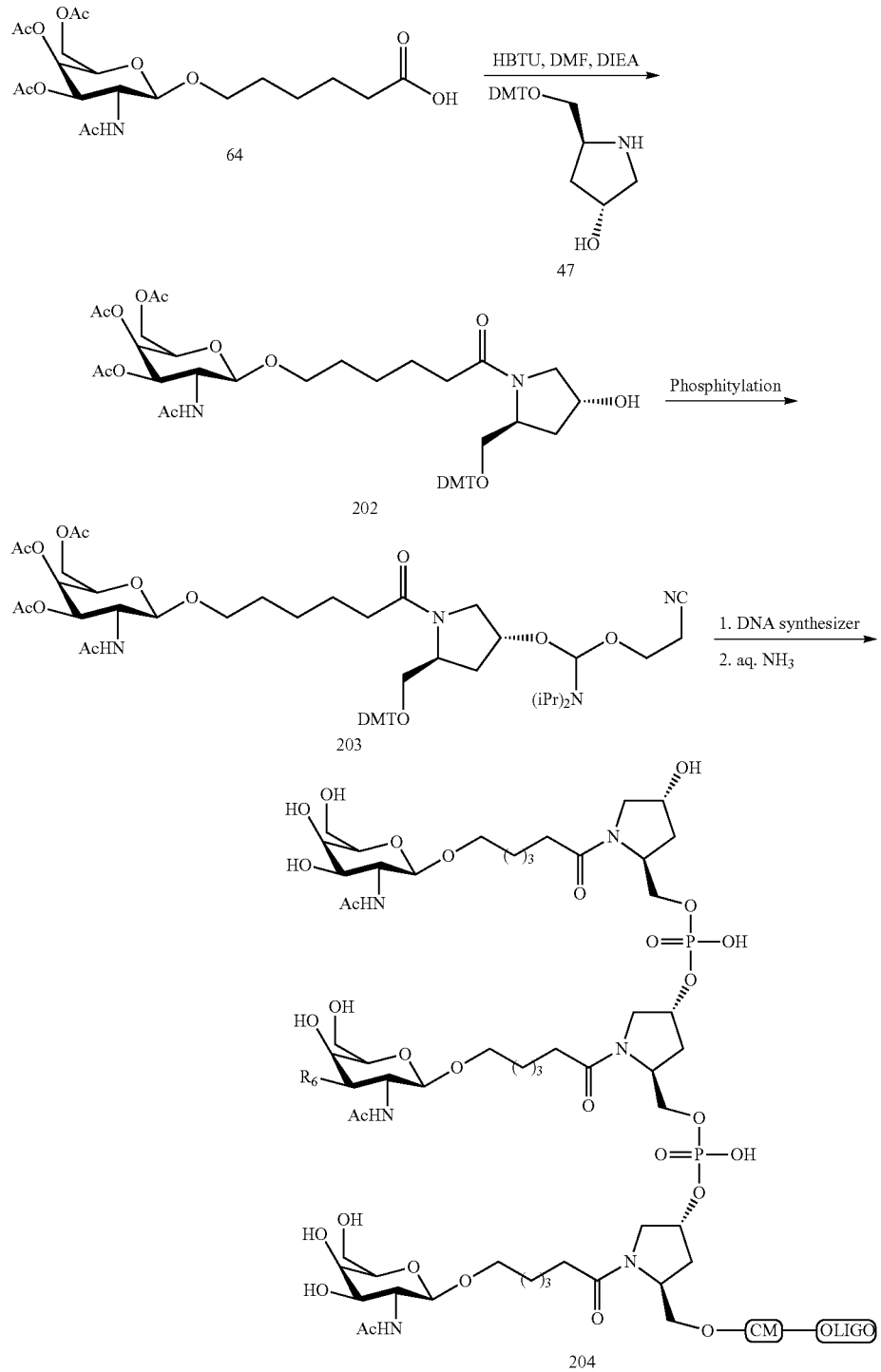

Oligomeric compound 204, comprising a GalNAc₃-19 conjugate group, was prepared from compound 64 using the general procedures illustrated in Example 52. The GalNAc₃ cluster portion of the conjugate group GalNAc₃-19 (GalNAc₃-19$_a$) can be combined with any cleavable moiety to provide a variety of conjugate groups. In certain embodiments, the cleavable moiety is —P(=O)(OH)-A$_d$-P(=O)(OH)—. The structure of GalNAc₃-19 (GalNAc₃-19$_a$-CM-) is shown below:

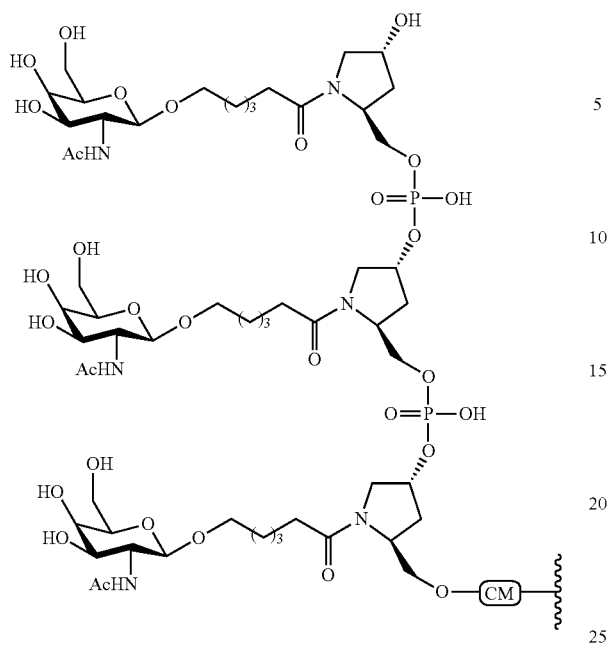
Example 71
Preparation of Oligomeric Compound 210 Comprising GalNAc$_3$-20
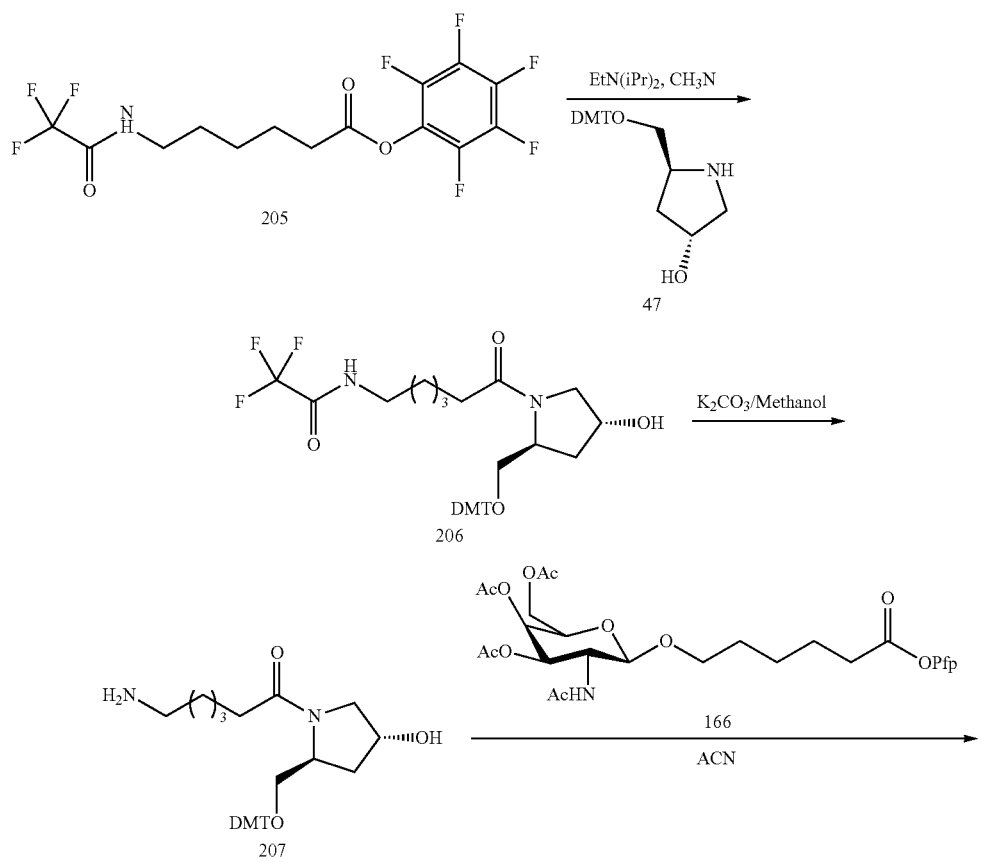

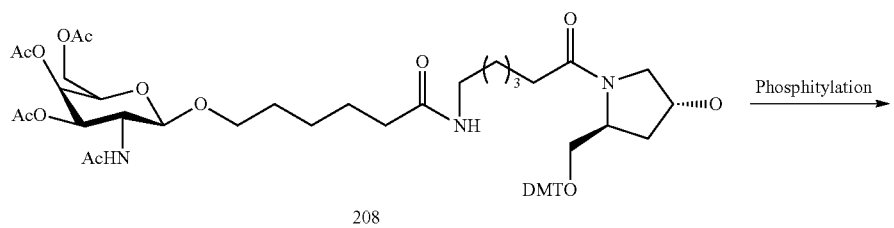

208

Phosphitylation →

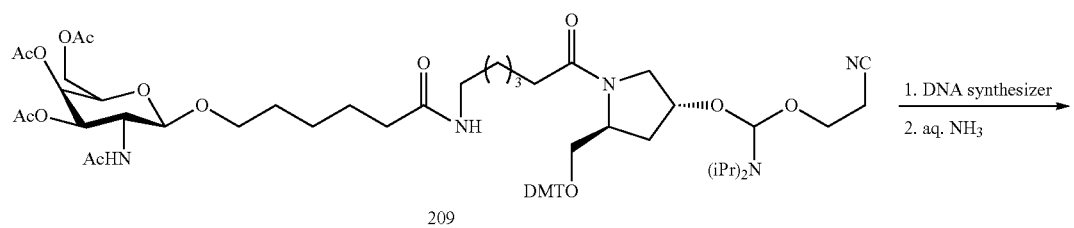

209

1. DNA synthesizer
2. aq. NH₃
→

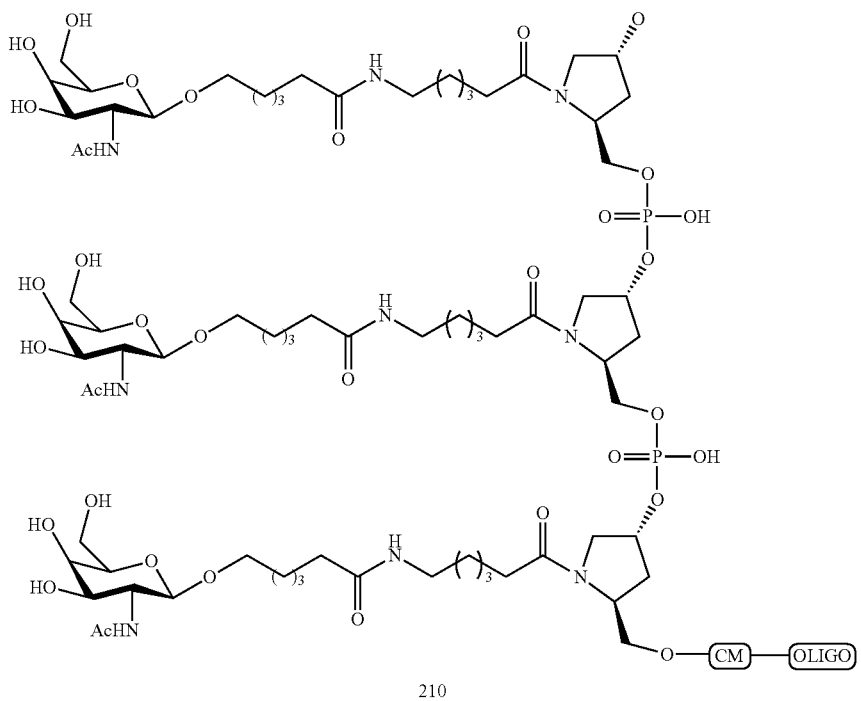

210

Compound 205 was prepared by adding PFP-TFA and DIEA to 6-(2,2,2-trifluoroacetamido)hexanoic acid in acetonitrile, which was prepared by adding triflic anhydride to 6-aminohexanoic acid. The reaction mixture was heated to 80° C., then lowered to rt. Oligomeric compound 210, comprising a GalNAc₃-20 conjugate group, was prepared from compound 208 using the general procedures illustrated in Example 52. The GalNAc₃ cluster portion of the conjugate group GalNAc₃-20 (GalNAc₃-20ₐ) can be combined with any cleavable moiety to provide a variety of conjugate groups. In certain embodiments, the cleavable moiety is —P(=O)(OH)-Aₐ-P(=O)(OH)—. The structure of GalNAc₃-20 (GalNAc₃-20ₐ-CM-) is shown below:

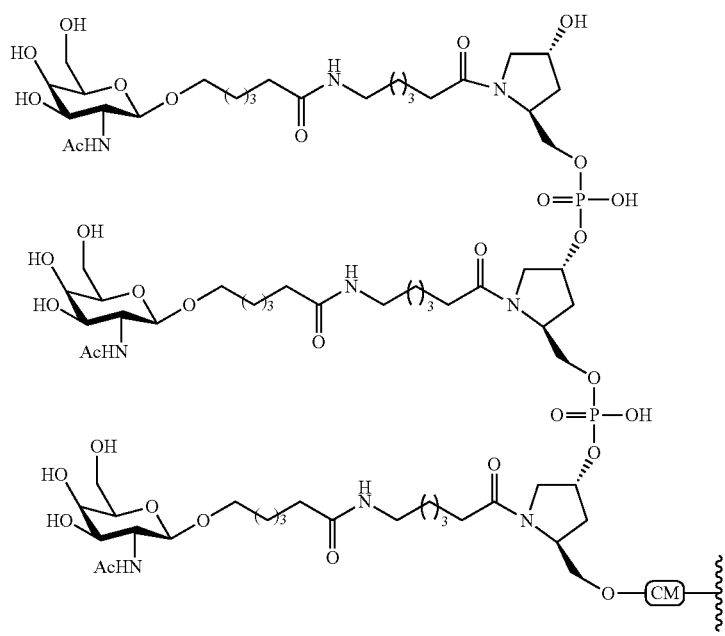
Example 72
Preparation of Oligomeric Compound 215 Comprising GalNAc$_3$-21
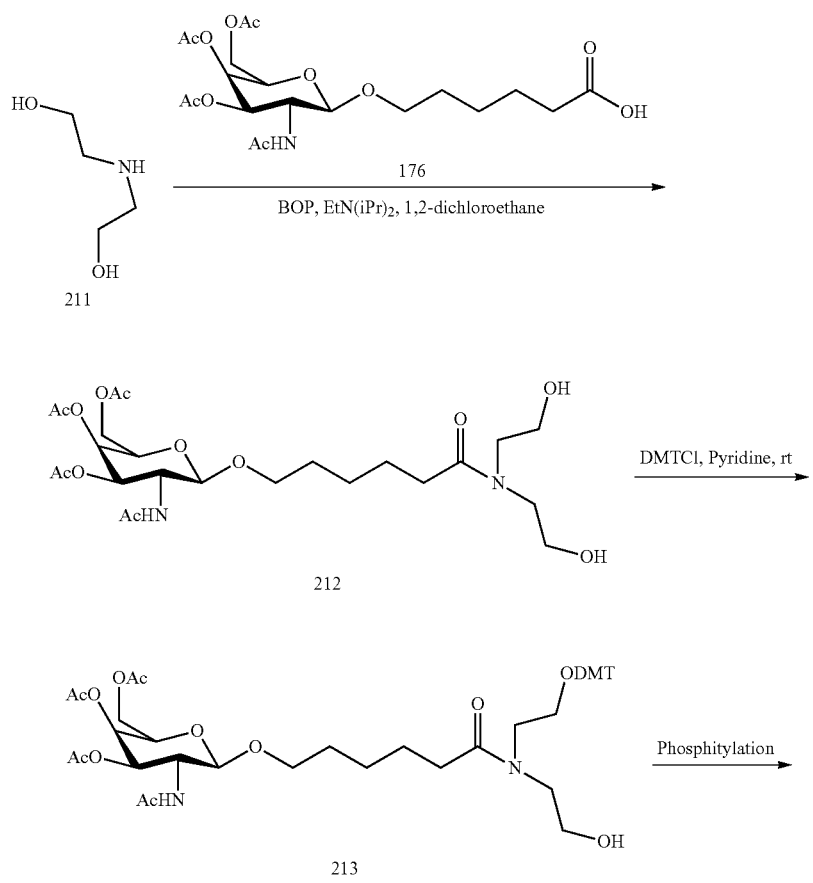

-continued

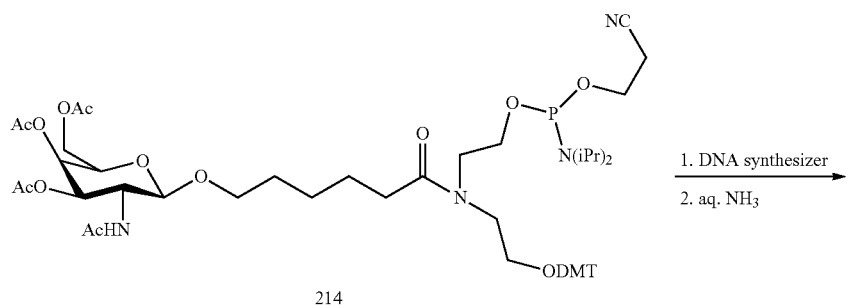
214

1. DNA synthesizer
2. aq. NH₃

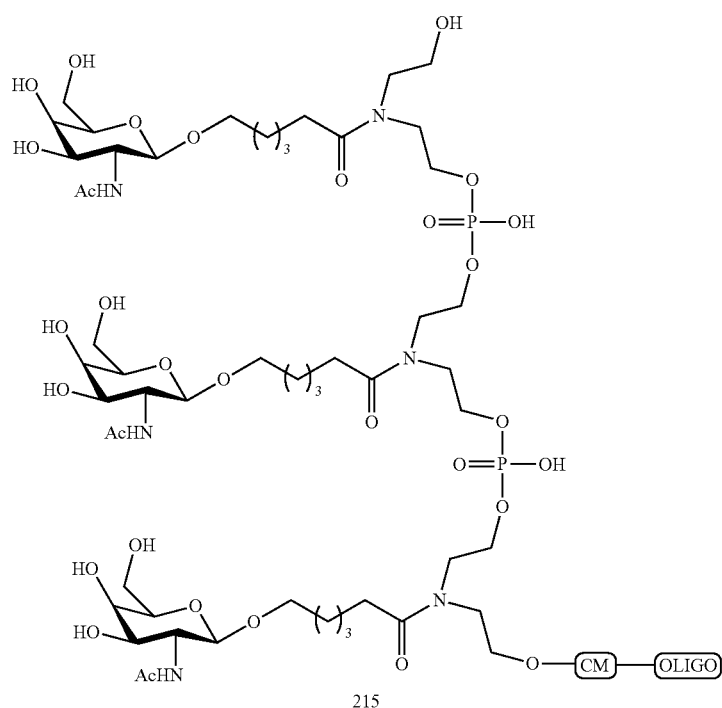
215

Compound 211 is commercially available. Oligomeric compound 215, comprising a GalNAc₃-21 conjugate group, was prepared from compound 213 using the general procedures illustrated in Example 52. The GalNAc₃ cluster portion of the conjugate group GalNAc₃-21 (GalNAc₃-21$_a$) can be combined with any cleavable moiety to provide a variety of conjugate groups. In certain embodiments, the cleavable moiety is —P(=O)(OH)-A$_d$-P(=O)(OH)—. The structure of GalNAc₃-21 (GalNAc₃-21$_a$-CM-) is shown below:

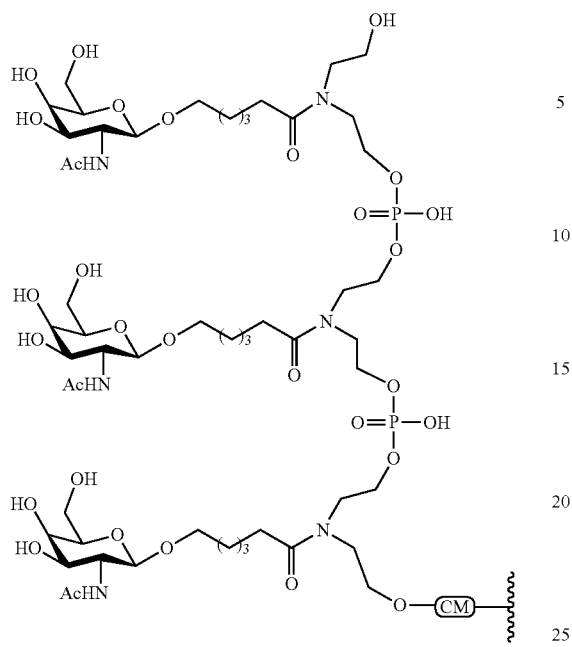
Example 73
Preparation of Oligomeric Compound 221 Comprising GalNAc$_3$-22
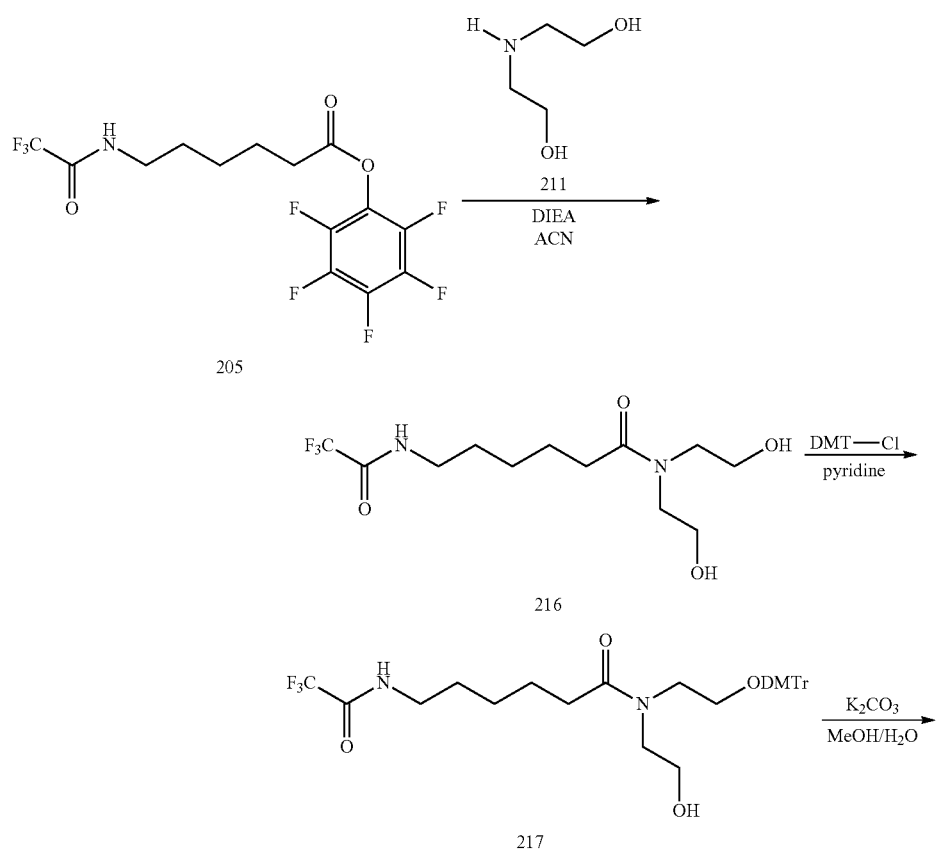

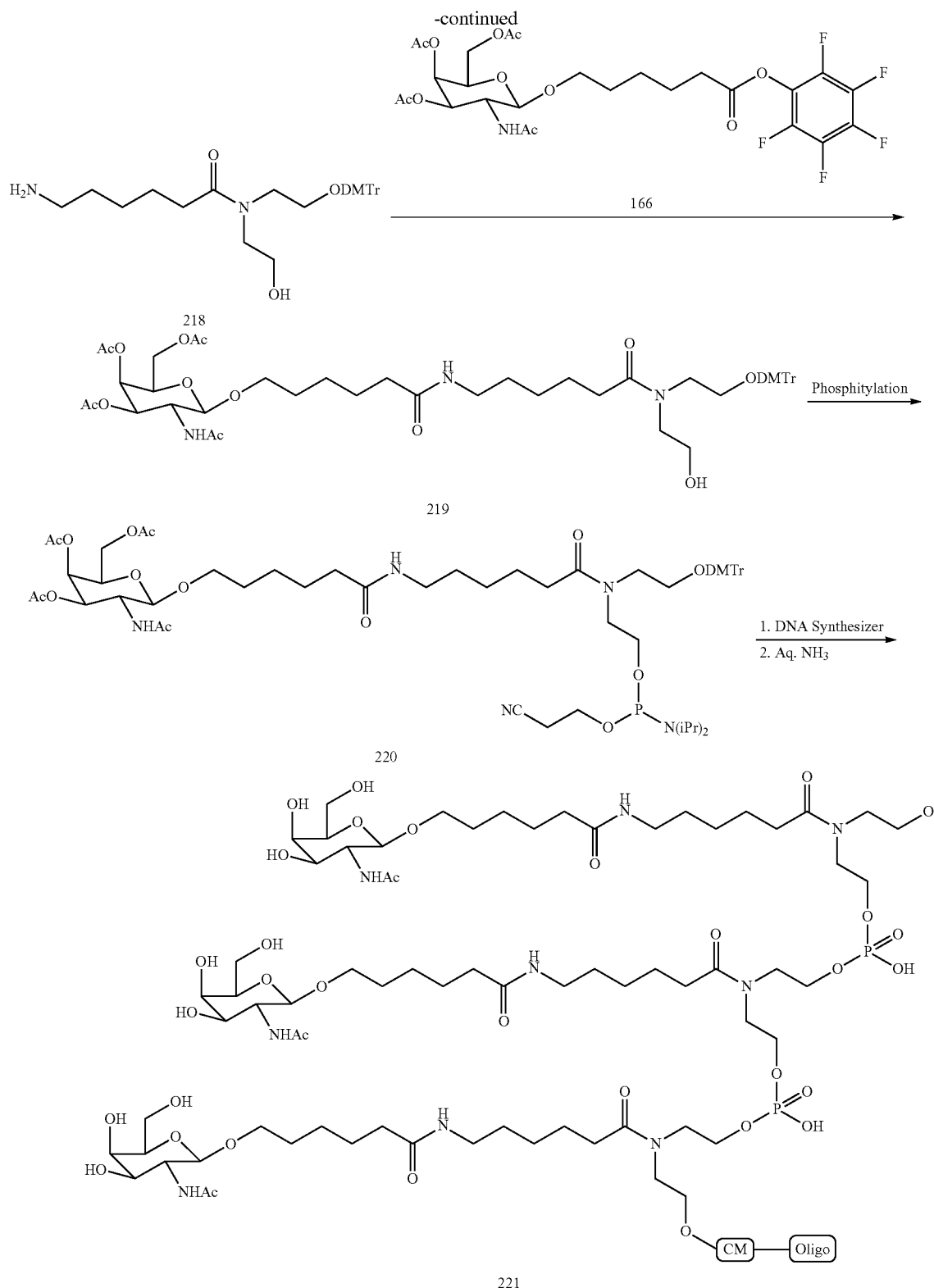

Compound 220 was prepared from compound 219 using diisopropylammonium tetrazolide. Oligomeric compound 221, comprising a GalNAc₃-21 conjugate group, is prepared from compound 220 using the general procedure illustrated in Example 52. The GalNAc₃ cluster portion of the conjugate group GalNAc₃-22 (GalNAc₃-22$_a$) can be combined with any cleavable moiety to provide a variety of conjugate groups. In certain embodiments, the cleavable moiety is —P(=O)(OH)-A$_d$-P(=O)(OH)—. The structure of GalNAc₃-22 (GalNAc₃-22$_a$-CM-) is shown below:

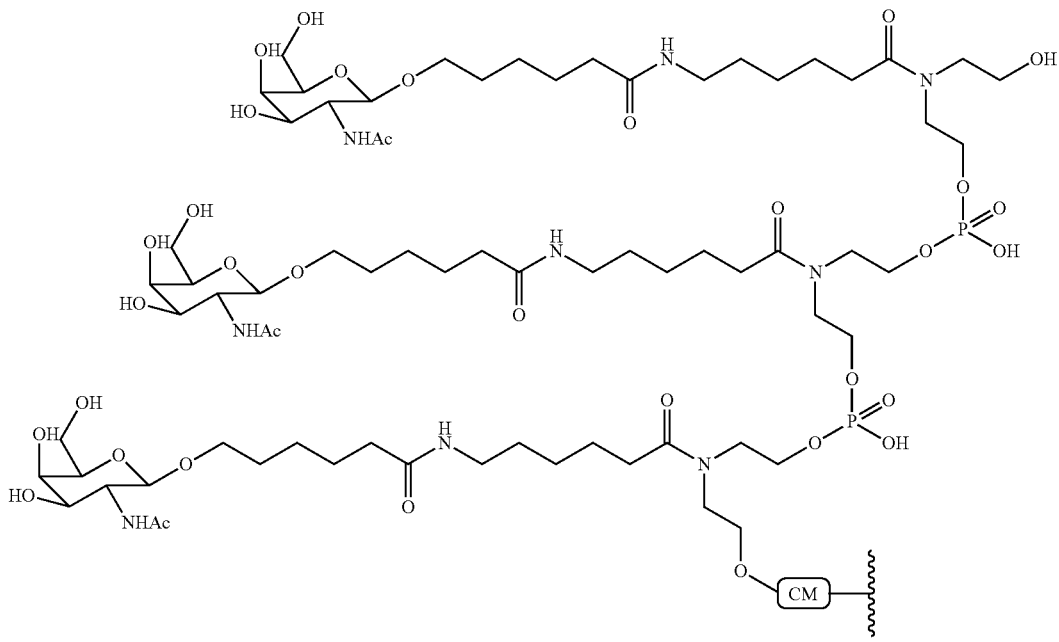

Example 74

Effect of Various Cleavable Moieties on Antisense Inhibition In Vivo by Oligonucleotides Targeting SRB-1 Comprising a 5'-GalNAc₃ Conjugate The oligonucleotides listed below were tested in a dose-dependent study for antisense inhibition of SRB-1 in mice. Each of the GalNAc₃ conjugate groups was attached at the 5' terminus of the respective oligonucleotide.

TABLE 60

Modified ASOs targeting SRB-1

| ISIS No. | Sequences (5' to 3') | GalNAc₃ Cluster | SEQ ID No. | CM |
|---|---|---|---|---|
| 353382 | $G_{es}{}^mC_{es}T_{es}T_{es}{}^mC_{es}A_{ds}G_{ds}T_{ds}{}^m$ $C_{ds}A_{ds}T_{ds}G_{ds}A_{ds}{}^mC_{ds}T_{ds}T_{es}{}^m$ $C_{es}{}^mC_{es}T_{es}T_e$ | n/a | 108 | n/a |
| 661161 | GalNAc₃-18$_a$-$_o$, $A_{do}G_{es}{}^mC_{es}T_{es}$ $T_{es}{}^mC_{es}A_{ds}G_{ds}T_{ds}{}^mC_{ds}A_{ds}T_{ds}$ $G_{ds}A_{ds}{}^mC_{ds}T_{ds}T_{es}{}^mC_{es}{}^mC_{es}T_{es}T_e$ | GalNAc₃-3a | 109 | $A_d$ |
| 666904 | GalNAc₃-3$_a$-$_o$, $G_{es}{}^mC_{es}T_{es}T_{es}{}^m$ $C_{es}A_{ds}G_{ds}T_{ds}{}^mC_{ds}A_{ds}T_{ds}G_{ds}A_{ds}{}^m$ $C_{ds}T_{ds}T_{es}{}^mC_{es}{}^mC_{es}T_{es}T_e$ | GalNAc₃-3a | 108 | PO |
| 675441 | GalNAc₃-17$_a$-$_o$, $A_{do}G_{es}{}^mC_{es}T_{es}$ $T_{es}{}^mC_{es}A_{ds}G_{ds}T_{ds}{}^mC_{ds}A_{ds}T_{ds}G_{ds}$ $A_{ds}{}^mC_{ds}T_{ds}T_{es}{}^mC_{es}{}^mC_{es}T_{es}T_e$ | GalNAc₃-17a | 109 | $A_d$ |

TABLE 60-continued

Modified ASOs targeting SRB-1

| ISIS No. | Sequences (5' to 3') | GalNAc₃ Cluster | SEQ ID No. | CM |
|---|---|---|---|---|
| 675442 | GalNAc₃-18$_a$-$_o$, $A_{do}G_{es}{}^mC_{es}T_{es}$ $T_{es}{}^mC_{es}A_{ds}G_{ds}T_{ds}{}^mC_{ds}A_{ds}T_{ds}G_{ds}$ $A_{ds}{}^mC_{ds}T_{ds}T_{es}{}^mC_{es}{}^mC_{es}T_{es}T_e$ | GalNAc₃-18a | 109 | $A_d$ |

In all tables, capital letters indicate the nucleobase for each nucleoside and $^mC$ indicates a 5-methyl cytosine.
Subscripts:
"e" indicates a 2'-MOE modified nucleoside;
"d" indicates a β-D-2'-deoxyribonucleoside;
"s" indicates a phosphorothioate internucleoside linkage (PS);
"o" indicates a phosphodiester internucleoside linkage (PO);
and
"o'" indicates -O-P(=O)(OH)-.
Conjugate groups are in bold.
The structure of GalNAc₃-3$_a$ was shown previously in Example 39.
The structure of GalNAc₃-17$_a$ was shown previously in Example 68, and the structure of GalNAc₃-18a was shown in Example 69.

Treatment

Six to eight week old C57BL/6 mice (Jackson Laboratory, Bar Harbor, Me.) were injected subcutaneously once at the dosage shown below with an oligonucleotide listed in Table 60 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 61, treatment with antisense oligonucleotides lowered SRB-1 mRNA levels in a dose-dependent manner. The antisense oligonucleotides comprising a GalNAc conjugate showed similar potencies and were significantly more potent than the parent oligonucleotide lacking a GalNAc conjugate.

TABLE 61

SRB-1 mRNA (% Saline)

| ISIS No. | Dosage (mg/kg) | SRB-1 mRNA (% Saline) | GalNAc₃ Cluster | CM |
|---|---|---|---|---|
| Saline | n/a | 100.0 | n/a | n/a |
| 353382 | 3 | 79.38 | n/a | n/a |
|  | 10 | 68.67 |  |  |
|  | 30 | 40.70 |  |  |
| 661161 | 0.5 | 79.18 | GalNAc₃-3a | $A_d$ |
|  | 1.5 | 75.96 |  |  |
|  | 5 | 30.53 |  |  |
|  | 15 | 12.52 |  |  |
| 666904 | 0.5 | 91.30 | GalNAc₃-3a | PO |
|  | 1.5 | 57.88 |  |  |
|  | 5 | 21.22 |  |  |
|  | 15 | 16.49 |  |  |
| 675441 | 0.5 | 76.71 | GalNAc₃-17a | $A_d$ |
|  | 1.5 | 63.63 |  |  |
|  | 5 | 29.57 |  |  |
|  | 15 | 13.49 |  |  |
| 675442 | 0.5 | 95.03 | GalNAc₃-18a | $A_d$ |
|  | 1.5 | 60.06 |  |  |
|  | 5 | 31.04 |  |  |
|  | 15 | 19.40 |  |  |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group (data not shown). ALTs, ASTs, total bilirubin and BUN values are shown in Table 62 below.

TABLE 62

| ISIS No. | Dosage (mg/kg) | ALT (U/L) | AST (U/L) | Total Bilirubin (mg/dL) | BUN (mg/dL) | GalNAc₃ Cluster | CM |
|---|---|---|---|---|---|---|---|
| Saline | n/a | 26 | 59 | 0.16 | 42 | n/a | n/a |
| 353382 | 3 | 23 | 58 | 0.18 | 39 | n/a | n/a |
|  | 10 | 28 | 58 | 0.16 | 43 |  |  |
|  | 30 | 20 | 48 | 0.12 | 34 |  |  |
| 661161 | 0.5 | 30 | 47 | 0.13 | 35 | GalNAc₃-3a | $A_d$ |
|  | 1.5 | 23 | 53 | 0.14 | 37 |  |  |
|  | 5 | 26 | 48 | 0.15 | 39 |  |  |
|  | 15 | 32 | 57 | 0.15 | 42 |  |  |
| 666904 | 0.5 | 24 | 73 | 0.13 | 36 | GalNAc₃-3a | PO |
|  | 1.5 | 21 | 48 | 0.12 | 32 |  |  |
|  | 5 | 19 | 49 | 0.14 | 33 |  |  |
|  | 15 | 20 | 52 | 0.15 | 26 |  |  |
| 675441 | 0.5 | 42 | 148 | 0.21 | 36 | GalNAc₃-17a | $A_d$ |
|  | 1.5 | 60 | 95 | 0.16 | 34 |  |  |
|  | 5 | 27 | 75 | 0.14 | 37 |  |  |
|  | 15 | 24 | 61 | 0.14 | 36 |  |  |
| 675442 | 0.5 | 26 | 65 | 0.15 | 37 | GalNAc₃-18a | $A_d$ |
|  | 1.5 | 25 | 64 | 0.15 | 43 |  |  |
|  | 5 | 27 | 69 | 0.15 | 37 |  |  |
|  | 15 | 30 | 84 | 0.14 | 37 |  |  |

Example 75

Pharmacokinetic Analysis of Oligonucleotides Comprising a 5'-Conjugate Group The PK of the ASOs in Tables 54, 57 and 60 above was evaluated using liver samples that were obtained following the treatment procedures described in Examples 65, 66, and 74. The liver samples were minced and extracted using standard protocols and analyzed by IP-HPLC-MS alongside an internal standard. The combined tissue level (μg/g) of all metabolites was measured by integrating the appropriate UV peaks, and the tissue level of the full-length ASO missing the conjugate ("parent," which is Isis No. 353382 in this case) was measured using the appropriate extracted ion chromatograms (EIC).

TABLE 63

PK Analysis in Liver

| ISIS No. | Dosage (mg/kg) | Total Tissue Level by UV (μg/g) | Parent ASO Tissue Level by EIC (μg/g) | GalNAc₃ Cluster | CM |
|---|---|---|---|---|---|
| 353382 | 3 | 8.9 | 8.6 | n/a | n/a |
|  | 10 | 22.4 | 21.0 |  |  |
|  | 30 | 54.2 | 44.2 |  |  |
| 661161 | 5 | 32.4 | 20.7 | GalNAc₃-3a | $A_d$ |
|  | 15 | 63.2 | 44.1 |  |  |
| 671144 | 5 | 20.5 | 19.2 | GalNAc₃-12a | $A_d$ |
|  | 15 | 48.6 | 41.5 |  |  |
| 670061 | 5 | 31.6 | 28.0 | GalNAc₃-13a | $A_d$ |
|  | 15 | 67.6 | 55.5 |  |  |
| 671261 | 5 | 19.8 | 16.8 | GalNAc₃-14a | $A_d$ |
|  | 15 | 64.7 | 49.1 |  |  |
| 671262 | 5 | 18.5 | 7.4 | GalNAc₃-15a | $A_d$ |
|  | 15 | 52.3 | 24.2 |  |  |
| 670699 | 5 | 16.4 | 10.4 | GalNAc₃-3a | $T_d$ |
|  | 15 | 31.5 | 22.5 |  |  |
| 670700 | 5 | 19.3 | 10.9 | GalNAc₃-3a | $A_e$ |
|  | 15 | 38.1 | 20.0 |  |  |
| 670701 | 5 | 21.8 | 8.8 | GalNAc₃-3a | $T_e$ |
|  | 15 | 35.2 | 16.1 |  |  |
| 671165 | 5 | 27.1 | 26.5 | GalNAc₃-13a | $A_d$ |
|  | 15 | 48.3 | 44.3 |  |  |
| 666904 | 5 | 30.8 | 24.0 | GalNac₃-3a | PO |
|  | 15 | 52.6 | 37.6 |  |  |
| 675441 | 5 | 25.4 | 19.0 | GalNAc₃-17a | $A_d$ |
|  | 15 | 54.2 | 42.1 |  |  |
| 675442 | 5 | 22.2 | 20.7 | GalNAc₃-18a | $A_d$ |
|  | 15 | 39.6 | 29.0 |  |  |

The results in Table 63 above show that there were greater liver tissue levels of the oligonucleotides comprising a GalNAc₃ conjugate group than of the parent oligonucleotide that does not comprise a GalNAc₃ conjugate group (ISIS 353382) 72 hours following oligonucleotide administration, particularly when taking into consideration the differences in dosing between the oligonucleotides with and without a GalNAc₃ conjugate group. Furthermore, by 72 hours, 40-98% of each oligonucleotide comprising a GalNAc₃ conjugate group was metabolized to the parent compound, indicating that the GalNAc₃ conjugate groups were cleaved from the oligonucleotides.

Example 76
Preparation of Oligomeric Compound 230 Comprising GalNAc₃-23
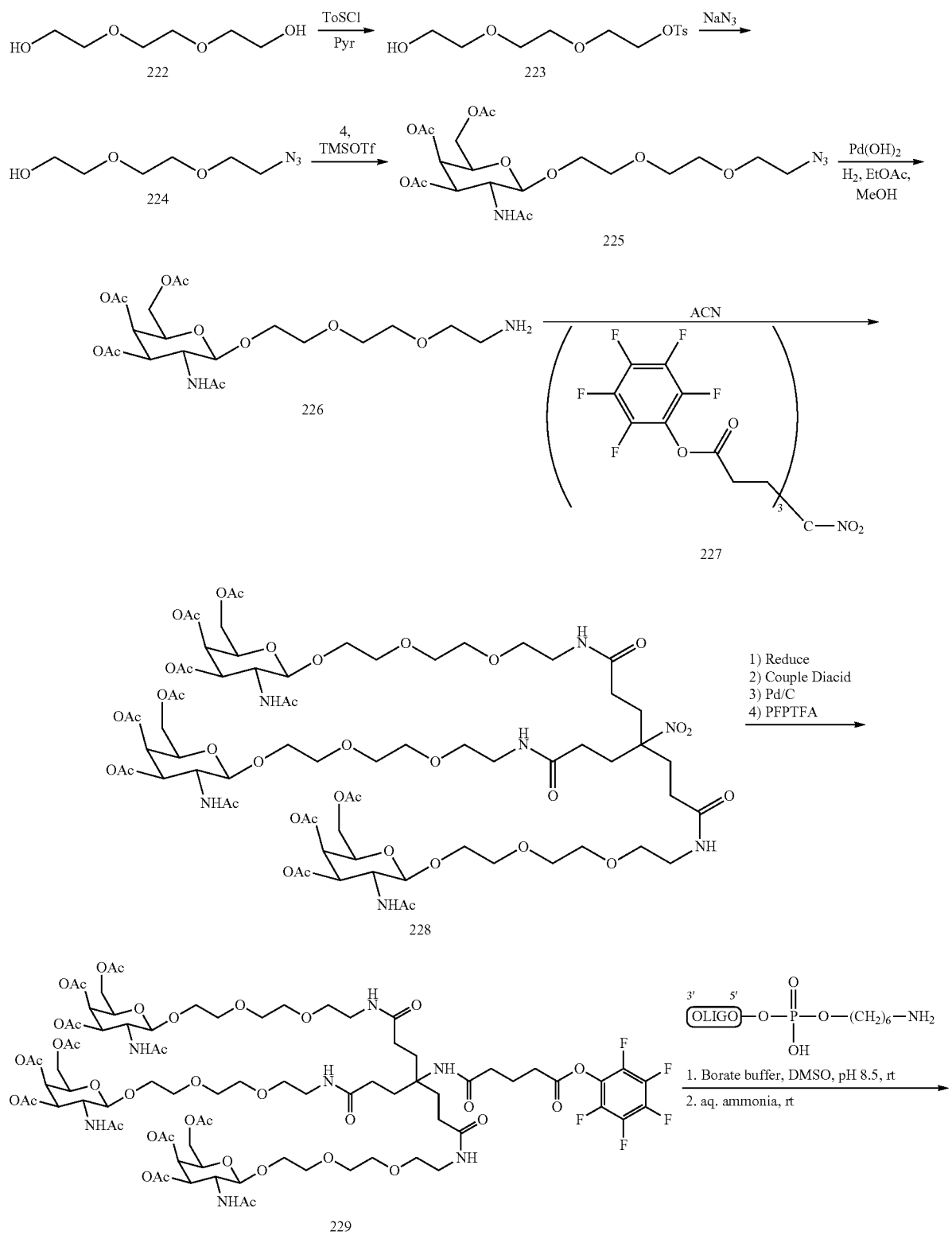

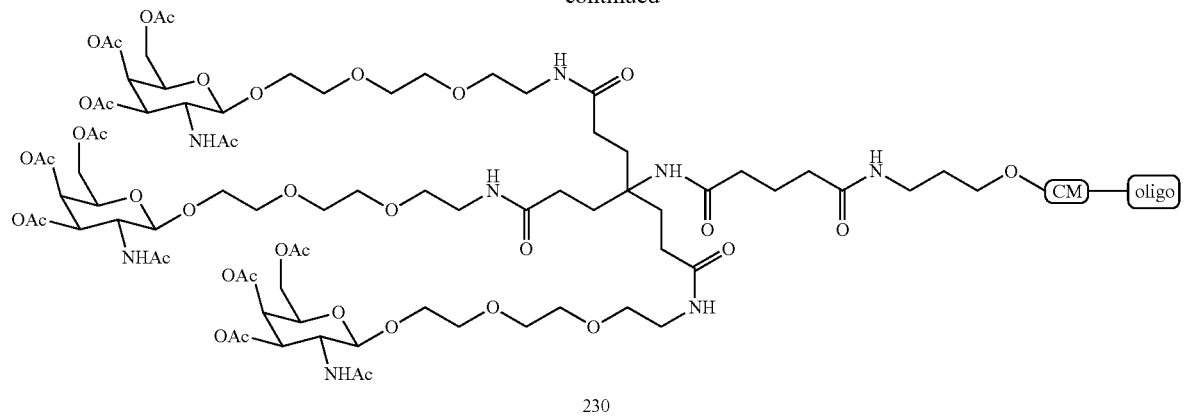

230

Compound 222 is commercially available. 44.48 ml (0.33 mol) of compound 222 was treated with tosyl chloride (25.39 g, 0.13 mol) in pyridine (500 mL) for 16 hours. The reaction was then evaporated to an oil, dissolved in EtOAc and washed with water, sat. NaHCO$_3$, brine, and dried over Na$_2$SO$_4$. The ethyl acetate was concentrated to dryness and purified by column chromatography, eluted with EtOAc/hexanes (1:1) followed by 10% methanol in CH$_2$Cl$_2$ to give compound 223 as a colorless oil. LCMS and NMR were consistent with the structure. 10 g (32.86 mmol) of 1-Tosyltriethylene glycol (compound 223) was treated with sodium azide (10.68 g, 164.28 mmol) in DMSO (100 mL) at room temperature for 17 hours. The reaction mixture was then poured onto water, and extracted with EtOAc. The organic layer was washed with water three times and dried over Na$_2$SO$_4$. The organic layer was concentrated to dryness to give 5.3 g of compound 224 (92%). LCMS and NMR were consistent with the structure. 1-Azidotriethylene glycol (compound 224, 5.53 g, 23.69 mmol) and compound 4 (6 g, 18.22 mmol) were treated with 4 A molecular sieves (5 g), and TMSOTf (1.65 ml, 9.11 mmol) in dichloromethane (100 mL) under an inert atmosphere. After 14 hours, the reaction was filtered to remove the sieves, and the organic layer was washed with sat. NaHCO$_3$, water, brine, and dried over Na$_2$SO$_4$. The organic layer was concentrated to dryness and purified by column chromatography, eluted with a gradient of 2 to 4% methanol in dichloromethane to give compound 225. LCMS and NMR were consistent with the structure. Compound 225 (11.9 g, 23.59 mmol) was hydrogenated in EtOAc/Methanol (4:1, 250 mL) over Pearlman's catalyst. After 8 hours, the catalyst was removed by filtration and the solvents removed to dryness to give compound 226. LCMS and NMR were consistent with the structure.

In order to generate compound 227, a solution of nitromethanetrispropionic acid (4.17 g, 15.04 mmol) and Hunig's base (10.3 ml, 60.17 mmol) in DMF (100 mL) were treated dropwise with pentafluorotrifluoro acetate (9.05 ml, 52.65 mmol). After 30 minutes, the reaction was poured onto ice water and extracted with EtOAc. The organic layer was washed with water, brine, and dried over Na$_2$SO$_4$. The organic layer was concentrated to dryness and then recrystallized from heptane to give compound 227 as a white solid. LCMS and NMR were consistent with the structure. Compound 227 (1.5 g, 1.93 mmol) and compound 226 (3.7 g, 7.74 mmol) were stirred at room temperature in acetonitrile (15 mL) for 2 hours. The reaction was then evaporated to dryness and purified by column chromatography, eluting with a gradient of 2 to 10% methanol in dichloromethane to give compound 228. LCMS and NMR were consistent with the structure. Compound 228 (1.7 g, 1.02 mmol) was treated with Raney Nickel (about 2 g wet) in ethanol (100 mL) in an atmosphere of hydrogen. After 12 hours, the catalyst was removed by filtration and the organic layer was evaporated to a solid that was used directly in the next step. LCMS and NMR were consistent with the structure. This solid (0.87 g, 0.53 mmol) was treated with benzylglutaric acid (0.18 g, 0.8 mmol), HBTU (0.3 g, 0.8 mmol) and DIEA (273.7 µl, 1.6 mmol) in DMF (5 mL). After 16 hours, the DMF was removed under reduced pressure at 65° C. to an oil, and the oil was dissolved in dichloromethane. The organic layer was washed with sat. NaHCO$_3$, brine, and dried over Na$_2$SO$_4$. After evaporation of the organic layer, the compound was purified by column chromatography and eluted with a gradient of 2 to 20% methanol in dichloromethane to give the coupled product. LCMS and NMR were consistent with the structure. The benzyl ester was deprotected with Pearlman's catalyst under a hydrogen atmosphere for 1 hour. The catalyst was them removed by filtration and the solvents removed to dryness to give the acid. LCMS and NMR were consistent with the structure. The acid (486 mg, 0.27 mmol) was dissolved in dry DMF (3 mL). Pyridine (53.61 µl, 0.66 mmol) was added and the reaction was purged with argon. Pentafluorotrifluoro acetate (46.39 µl, 0.4 mmol) was slowly added to the reaction mixture. The color of the reaction changed from pale yellow to burgundy, and gave off a light smoke which was blown away with a stream of argon. The reaction was allowed to stir at room temperature for one hour (completion of reaction was confirmed by LCMS). The solvent was removed under reduced pressure (rotovap) at 70° C. The residue was diluted with DCM and washed with 1N NaHSO$_4$, brine, saturated sodium bicarbonate and brine again. The organics were dried over Na$_2$SO$_4$, filtered, and were concentrated to dryness to give 225 mg of compound 229 as a brittle yellow foam. LCMS and NMR were consistent with the structure.

Oligomeric compound 230, comprising a GalNAc$_3$-23 conjugate group, was prepared from compound 229 using the general procedure illustrated in Example 46. The GalNAc$_3$ cluster portion of the GalNAc$_3$-23 conjugate group (GalNAc$_3$-23$_a$) can be combined with any cleavable moiety to provide a variety of conjugate groups. The structure of GalNAc$_3$-23 (GalNAc$_3$-23$_a$-CM) is shown below:

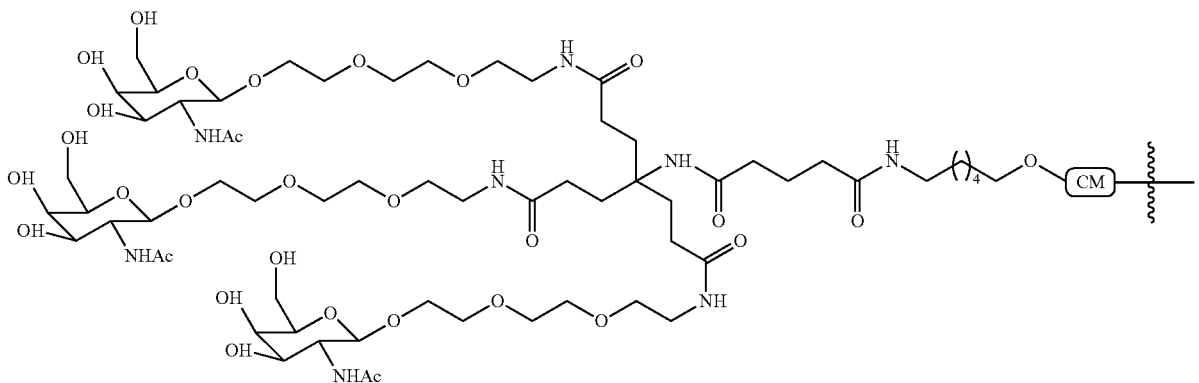

Example 77

Antisense Inhibition In Vivo by Oligonucleotides Targeting SRB-1 Comprising a GalNAc₃ Conjugate The oligonucleotides listed below were tested in a dose-dependent study for antisense inhibition of SRB-1 in mice.

TABLE 64

Modified ASOs targeting SRB-1

| ISIS No. | Sequences (5' to 3') | GalNAc₃ Cluster | CM | SEQ ID No. |
|---|---|---|---|---|
| 661161 | GalNAc₃-3$_{a}$-$_{o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-3a | A$_d$ | 109 |
| 666904 | GalNAc₃-3$_{a}$-$_{o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$mC$_{es}$T$_{es}$T$_{e}$ | GalNAc₃-3a | PO | 108 |
| 673502 | GalNAc₃-10$_{a}$-$_{o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-10a | A$_d$ | 109 |
| 677844 | GalNAc₃-9$_{a}$-$_{o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-9a | A$_d$ | 109 |
| 677843 | GalNAc₃-23$_{a}$-$_{o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-23a | A$_d$ | 109 |
| 655861 | G$_{es}$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{es}$T$_{eo}$A$_{do}$,-GalNAc₃-1$_a$ | GalNAc₃-1a | A$_d$ | 110 |
| 677841 | G$_{es}$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{es}$T$_{eo}$A$_{do}$,-GalNAc₃-19$_a$ | GalNAc₃-19a | A$_d$ | 110 |
| 677842 | G$_{es}$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{es}$T$_{eo}$A$_{do}$,-GalNAc₃-20$_a$ | GalNAc₃-20a | A$_d$ | 110 |

The structure of GalNAc₃-1$_a$ was shown previously in Example 9, GalNAc₃-3$_a$ was shown in Example 39, GalNAc₃-9$_a$ was shown in Example 52, GalNAc₃-10$_a$ was shown in Example 46, GalNAc₃-19$_a$ was shown in Example 70, GalNAc3-20$_a$ was shown in Example 71, and GalNAc₃-23$_a$ was shown in Example 76.

Treatment

Six to eight week old C57BL/6 mice (Jackson Laboratory, Bar Harbor, Me.) were each injected subcutaneously once at a dosage shown below with an oligonucleotide listed in Table 64 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 65, treatment with antisense oligonucleotides lowered SRB-1 mRNA levels in a dose-dependent manner.

TABLE 65

SRB-1 mRNA (% Saline)

| ISIS No. | Dosage (mg/kg) | SRB-1 mRNA (% Saline) | GalNAc₃ Cluster | CM |
|---|---|---|---|---|
| Saline | n/a | 100.0 | n/a | n/a |
| 661161 | 0.5 | 89.18 | GalNAc₃-3a | A$_d$ |
|  | 1.5 | 77.02 |  |  |
|  | 5 | 29.10 |  |  |
|  | 15 | 12.64 |  |  |
| 666904 | 0.5 | 93.11 | GalNAc₃-3a | PO |
|  | 1.5 | 55.85 |  |  |
|  | 5 | 21.29 |  |  |
|  | 15 | 13.43 |  |  |
| 673502 | 0.5 | 77.75 | GalNAc₃-10a | A$_d$ |
|  | 1.5 | 41.05 |  |  |
|  | 5 | 19.27 |  |  |
|  | 15 | 14.41 |  |  |
| 677844 | 0.5 | 87.65 | GalNAc₃-9a | A$_d$ |
|  | 1.5 | 93.04 |  |  |
|  | 5 | 40.77 |  |  |
|  | 15 | 16.95 |  |  |
| 677843 | 0.5 | 102.28 | GalNAc₃-23a | A$_d$ |
|  | 1.5 | 70.51 |  |  |
|  | 5 | 30.68 |  |  |
|  | 15 | 13.26 |  |  |
| 655861 | 0.5 | 79.72 | GalNAc₃-1a | A$_d$ |
|  | 1.5 | 55.48 |  |  |
|  | 5 | 26.99 |  |  |
|  | 15 | 17.58 |  |  |
| 677841 | 0.5 | 67.43 | GalNAc₃-19a | A$_d$ |
|  | 1.5 | 45.13 |  |  |
|  | 5 | 27.02 |  |  |
|  | 15 | 12.41 |  |  |
| 677842 | 0.5 | 64.13 | GalNAc₃-20a | A$_d$ |
|  | 1.5 | 53.56 |  |  |
|  | 5 | 20.47 |  |  |
|  | 15 | 10.23 |  |  |

Liver transaminase levels, alanine aminotransferase (ALT) and aspartate aminotransferase (AST), in serum were also measured using standard protocols. Total bilirubin and BUN were also evaluated. Changes in body weights were evaluated, with no significant change from the saline group (data not shown). ALTs, ASTs, total bilirubin and BUN values are shown in Table 66 below.

TABLE 66

| ISIS No. | Dosage (mg/kg) | ALT (U/L) | AST (U/L) | Total Bilirubin (mg/dL) | BUN (mg/dL) | GalNAc₃ Cluster | CM |
|---|---|---|---|---|---|---|---|
| Saline | n/a | 21 | 45 | 0.13 | 34 | n/a | n/a |
| 661161 | 0.5 | 28 | 51 | 0.14 | 39 | GalNAc₃-3a | $A_d$ |
|  | 1.5 | 23 | 42 | 0.13 | 39 |  |  |
|  | 5 | 22 | 59 | 0.13 | 37 |  |  |
|  | 15 | 21 | 56 | 0.15 | 35 |  |  |
| 666904 | 0.5 | 24 | 56 | 0.14 | 37 | GalNAc₃-3a | PO |
|  | 1.5 | 26 | 68 | 0.15 | 35 |  |  |
|  | 5 | 23 | 77 | 0.14 | 34 |  |  |
|  | 15 | 24 | 60 | 0.13 | 35 |  |  |
| 673502 | 0.5 | 24 | 59 | 0.16 | 34 | GalNAc₃-10a | $A_d$ |
|  | 1.5 | 20 | 46 | 0.17 | 32 |  |  |
|  | 5 | 24 | 45 | 0.12 | 31 |  |  |
|  | 15 | 24 | 47 | 0.13 | 34 |  |  |
| 677844 | 0.5 | 25 | 61 | 0.14 | 37 | GalNAc₃-9a | $A_d$ |
|  | 1.5 | 23 | 64 | 0.17 | 33 |  |  |
|  | 5 | 25 | 58 | 0.13 | 35 |  |  |
|  | 15 | 22 | 65 | 0.14 | 34 |  |  |
| 677843 | 0.5 | 53 | 53 | 0.13 | 35 | GalNAc₃-23a | $A_d$ |
|  | 1.5 | 25 | 54 | 0.13 | 34 |  |  |
|  | 5 | 21 | 60 | 0.15 | 34 |  |  |
|  | 15 | 22 | 43 | 0.12 | 38 |  |  |
| 655861 | 0.5 | 21 | 48 | 0.15 | 33 | GalNAc₃-1a | $A_d$ |
|  | 1.5 | 28 | 54 | 0.12 | 35 |  |  |
|  | 5 | 22 | 60 | 0.13 | 36 |  |  |
|  | 15 | 21 | 55 | 0.17 | 30 |  |  |
| 677841 | 0.5 | 32 | 54 | 0.13 | 34 | GalNAc₃-19a | $A_d$ |
|  | 1.5 | 24 | 56 | 0.14 | 34 |  |  |
|  | 5 | 23 | 92 | 0.18 | 31 |  |  |
|  | 15 | 24 | 58 | 0.15 | 31 |  |  |
| 677842 | 0.5 | 23 | 61 | 0.15 | 35 | GalNAc₃-20a | $A_d$ |
|  | 1.5 | 24 | 57 | 0.14 | 34 |  |  |
|  | 5 | 41 | 62 | 0.15 | 35 |  |  |
|  | 15 | 24 | 37 | 0.14 | 32 |  |  |

Example 78

Antisense Inhibition In Vivo by Oligonucleotides Targeting Angiotensinogen Comprising a GalNAc₃ Conjugate The oligonucleotides listed below were tested in a dose-dependent study for antisense inhibition of Angiotensinogen (AGT) in normotensive Sprague Dawley rats.

TABLE 67

Modified ASOs targeting AGT

| ISIS No. | Sequences (5' to 3') | GalNAc₃ Cluster | CM | SEQ ID No. |
|---|---|---|---|---|
| 552668 | $^mC_{es}A_{es}{}^mC_{es}T_{es}G_{es}A_{ds}T_{ds}T_{ds}T_{ds}T_{ds}T_{ds}G_{ds}{}^mC_{ds}{}^mC_{ds}{}^mC_{ds}A_{es}G_{es}A_{es}T_e$ | n/a | n/a | 117 |
| 669509 | $^mC_{es}A_{es}{}^mC_{es}T_{es}G_{es}A_{ds}T_{ds}T_{ds}T_{ds}T_{ds}T_{ds}G_{ds}{}^mC_{ds}{}^mC_{ds}{}^mC_{ds}A_{es}G_{es}A_{es}T_{eo}\mathbf{A}_{do}$, -GalNAc₃-1$_a$ | GalNAc₃-1$_a$ | $A_d$ | 118 |

The structure of GalNAc₃-1$_a$ was shown previously in Example 9.

Treatment

Six week old, male Sprague Dawley rats were each injected subcutaneously once per week at a dosage shown below, for a total of three doses, with an oligonucleotide listed in Table 67 or with PBS. Each treatment group consisted of 4 animals. The rats were sacrificed 72 hours following the final dose. AGT liver mRNA levels were measured using real-time PCR and RIBOGREEN® RNA quantification reagent (Molecular Probes, Inc. Eugene, Oreg.) according to standard protocols. AGT plasma protein levels were measured using the Total Angiotensinogen ELISA (Catalog #JP27412, IBL International, Toronto, ON) with plasma diluted 1:20,000. The results below are presented as the average percent of AGT mRNA levels in liver or AGT protein levels in plasma for each treatment group, normalized to the PBS control.

As illustrated in Table 68, treatment with antisense oligonucleotides lowered AGT liver mRNA and plasma protein levels in a dose-dependent manner, and the oligonucleotide comprising a GalNAc conjugate was significantly more potent than the parent oligonucleotide lacking a GalNAc conjugate.

TABLE 68

AGT liver mRNA and plasma protein levels

| ISIS No. | Dosage (mg/kg) | AGT liver mRNA (% PBS) | AGT plasma protein (% PBS) | GalNAc₃ Cluster | CM |
|---|---|---|---|---|---|
| PBS | n/a | 100 | 100 | n/a | n/a |
| 552668 | 3 | 95 | 122 | n/a | n/a |
|  | 10 | 85 | 97 |  |  |
|  | 30 | 46 | 79 |  |  |
|  | 90 | 8 | 11 |  |  |
| 669509 | 0.3 | 95 | 70 | GalNAc₃-1a | $A_d$ |
|  | 1 | 95 | 129 |  |  |
|  | 3 | 62 | 97 |  |  |
|  | 10 | 9 | 23 |  |  |

Liver transaminase levels, alanine aminotransferase (ALT) and aspartate aminotransferase (AST), in plasma and body weights were also measured at time of sacrifice using standard protocols. The results are shown in Table 69 below.

TABLE 69

Liver transaminase levels and rat body weights

| ISIS No. | Dosage (mg/kg) | ALT (U/L) | AST (U/L) | Body Weight (% of baseline) | GalNAc₃ Cluster | CM |
|---|---|---|---|---|---|---|
| PBS | n/a | 51 | 81 | 186 | n/a | n/a |
| 552668 | 3 | 54 | 93 | 183 | n/a | n/a |
|  | 10 | 51 | 93 | 194 |  |  |
|  | 30 | 59 | 99 | 182 |  |  |
|  | 90 | 56 | 78 | 170 |  |  |
| 669509 | 0.3 | 53 | 90 | 190 | GalNAc₃-1a | $A_d$ |
|  | 1 | 51 | 93 | 192 |  |  |
|  | 3 | 48 | 85 | 189 |  |  |
|  | 10 | 56 | 95 | 189 |  |  |

Example 79

Duration of Action In Vivo of Oligonucleotides Targeting APOC-III Comprising a GalNAc₃ Conjugate The oligonucleotides listed in Table 70 below were tested in a single dose study for duration of action in mice.

TABLE 70

Modified ASOs targeting APOC-III

| ISIS No. | Sequences (5' to 3') | GalNAc₃ Cluster | CM | SEQ ID No. |
|---|---|---|---|---|
| 304801 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | n/a | n/a | 32 |
| 647535 | $A_{es}G_{es}C_{es}{}^mT_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_{eo}A_{do}\text{,-}\textbf{GalNAc}_3\textbf{-1}_a$ | GalNAc₃-1a | $A_d$ | 111 |
| 663083 | $\textbf{GalNAc}_3\textbf{-3}_{a'o}\text{,}A_{do}A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | GalNAc₃-3a | $A_d$ | 119 |
| 674449 | $\textbf{GalNAc}_3\textbf{-7}_{a'o}\text{,}A_{do}A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | GalNAc₃-7a | $A_d$ | 119 |
| 674450 | $\textbf{GalNAc}_3\textbf{-10}_{a'o}\text{,}A_{do}A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | GalNAc₃-10a | $A_d$ | 119 |
| 674451 | $\textbf{GalNAc}_3\textbf{-13}_{a'o}\text{,}A_{do}A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | GalNAc₃-13a | $A_d$ | 119 |

The structure of GalNAc₃-1ₐ was shown previously in Example 9, GalNAc₃-3ₐ was shown in Example 39, GalNAc₃-7ₐ was shown in Example 48, GalNAc₃-10ₐ was shown in Example 46, GalNAc₃-13ₐ was shown in Example 62.

Treatment

Six to eight week old transgenic mice that express human APOC-III were each injected subcutaneously once with an oligonucleotide listed in Table 70 or with PBS. Each treatment group consisted of 3 animals. Blood was drawn before dosing to determine baseline and at 72 hours, 1 week, 2 weeks, 3 weeks, 4 weeks, 5 weeks, and 6 weeks following the dose. Plasma triglyceride and APOC-III protein levels were measured as described in Example 20. The results below are presented as the average percent of plasma triglyceride and APOC-III levels for each treatment group, normalized to baseline levels, showing that the oligonucleotides comprising a GalNAc conjugate group exhibited a longer duration of action than the parent oligonucleotide without a conjugate group (ISIS 304801) even though the dosage of the parent was three times the dosage of the oligonucleotides comprising a GalNAc conjugate group.

TABLE 71

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc₃ Cluster | CM |
|---|---|---|---|---|---|---|
| PBS | n/a | 3 | 97 | 102 | n/a | n/a |
| | | 7 | 101 | 98 | | |
| | | 14 | 108 | 98 | | |
| | | 21 | 107 | 107 | | |
| | | 28 | 94 | 91 | | |
| | | 35 | 88 | 90 | | |
| | | 42 | 91 | 105 | | |
| 304801 | 30 | 3 | 40 | 34 | n/a | n/a |
| | | 7 | 41 | 37 | | |
| | | 14 | 50 | 57 | | |
| | | 21 | 50 | 50 | | |
| | | 28 | 57 | 73 | | |
| | | 35 | 68 | 70 | | |
| | | 42 | 75 | 93 | | |
| 647535 | 10 | 3 | 36 | 37 | GalNAc₃-1a | $A_d$ |
| | | 7 | 39 | 47 | | |
| | | 14 | 40 | 45 | | |
| | | 21 | 41 | 41 | | |
| | | 28 | 42 | 62 | | |
| | | 35 | 69 | 69 | | |
| | | 42 | 85 | 102 | | |
| 663083 | 10 | 3 | 24 | 18 | GalNAc₃-3a | $A_d$ |
| | | 7 | 28 | 23 | | |
| | | 14 | 25 | 27 | | |
| | | 21 | 28 | 28 | | |
| | | 28 | 37 | 44 | | |
| | | 35 | 55 | 57 | | |
| | | 42 | 60 | 78 | | |
| 674449 | 10 | 3 | 29 | 26 | GalNAc₃-7a | $A_d$ |
| | | 7 | 32 | 31 | | |
| | | 14 | 38 | 41 | | |
| | | 21 | 44 | 44 | | |
| | | 28 | 53 | 63 | | |
| | | 35 | 69 | 77 | | |
| | | 42 | 78 | 99 | | |
| 674450 | 10 | 3 | 33 | 30 | GalNAc₃-10a | $A_d$ |
| | | 7 | 35 | 34 | | |
| | | 14 | 31 | 34 | | |
| | | 21 | 44 | 44 | | |
| | | 28 | 56 | 61 | | |
| | | 35 | 68 | 70 | | |
| | | 42 | 83 | 95 | | |
| 674451 | 10 | 3 | 35 | 33 | GalNAc₃-13a | $A_d$ |
| | | 7 | 24 | 32 | | |
| | | 14 | 40 | 34 | | |
| | | 21 | 48 | 48 | | |
| | | 28 | 54 | 67 | | |
| | | 35 | 65 | 75 | | |
| | | 42 | 74 | 97 | | |

Example 80

Antisense Inhibition In Vivo by Oligonucleotides Targeting Alpha-1 Antitrypsin (A1AT) Comprising a GalNAc₃ Conjugate The oligonucleotides listed in Table 72 below were tested in a study for dose-dependent inhibition of A1AT in mice.

TABLE 72

Modified ASOs targeting A1AT

| ISIS No. | Sequences (5' to 3') | GalNAc₃ Cluster | CM | SEQ ID No. |
|---|---|---|---|---|
| 476366 | $A_{es}{}^mC_{es}{}^mC_{es}{}^mC_{es}A_{es}A_{ds}T_{ds}T_{ds}{}^mC_{ds}A_{ds}G_{ds}A_{ds}A_{ds}G_{ds}G_{ds}A_{es}A_{es}G_{es}G_{es}A_e$ | n/a | n/a | 120 |
| 656326 | $A_{es}{}^mC_{es}{}^mC_{es}{}^mC_{es}A_{es}A_{ds}T_{ds}T_{ds}{}^mC_{ds}A_{ds}G_{ds}A_{ds}A_{ds}G_{ds}G_{ds}A_{es}A_{es}G_{es}G_{es}A_{eo}A_{do}\text{,-}\textbf{GalNAc}_3\textbf{-1}_a$ | GalNAc₃-1a | $A_d$ | 121 |
| 678381 | $\textbf{GalNAc}_3\textbf{-3}_{a'o}\text{,}A_{do}A_{es}{}^mC_{es}{}^m C_{es}{}^mC_{es}A_{es}A_{ds}T_{ds}T_{ds}{}^mC_{ds}A_{ds}G_{ds}A_{ds}A_{ds}G_{ds}G_{ds}A_{es}A_{es}G_{es}G_{es}A_e$ | GalNAc₃-3a | $A_d$ | 122 |

TABLE 72-continued

Modified ASOs targeting A1AT

| ISIS No. | Sequences (5' to 3') | GalNAc$_3$ Cluster | CM | SEQ ID No. |
|---|---|---|---|---|
| 678382 | GalNAc$_3$-7$_a$-$_o$·A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-7a | A$_d$ | 122 |
| 678383 | GalNAc$_3$-10$_a$-$_o$·A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-10a | A$_d$ | 122 |
| 678384 | GalNAc$_3$-13$_a$-$_o$·A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-13a | A$_d$ | 122 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, GalNAc$_3$-13$_a$ was shown in Example 62.

Treatment

Six week old, male C57BL/6 mice (Jackson Laboratory, Bar Harbor, Me.) were each injected subcutaneously once per week at a dosage shown below, for a total of three doses, with an oligonucleotide listed in Table 72 or with PBS. Each treatment group consisted of 4 animals. The mice were sacrificed 72 hours following the final administration. A1AT liver mRNA levels were determined using real-time PCR and RIBOGREEN® RNA quantification reagent (Molecular Probes, Inc. Eugene, Oreg.) according to standard protocols. A1AT plasma protein levels were determined using the Mouse Alpha 1-Antitrypsin ELISA (catalog #41-A1AMS-E01, Alpco, Salem, N.H.). The results below are presented as the average percent of A1AT liver mRNA and plasma protein levels for each treatment group, normalized to the PBS control.

As illustrated in Table 73, treatment with antisense oligonucleotides lowered A1AT liver mRNA and A1AT plasma protein levels in a dose-dependent manner. The oligonucleotides comprising a GalNAc conjugate were significantly more potent than the parent (ISIS 476366).

TABLE 73

A1AT liver mRNA and plasma protein levels

| ISIS No. | Dosage (mg/kg) | A1AT liver mRNA (% PBS) | A1AT plasma protein (% PBS) | GalNAc$_3$ Cluster | CM |
|---|---|---|---|---|---|
| PBS | n/a | 100 | 100 | n/a | n/a |
| 476366 | 5 | 86 | 78 | n/a | n/a |
|  | 15 | 73 | 61 |  |  |
|  | 45 | 30 | 38 |  |  |
| 656326 | 0.6 | 99 | 90 | GalNAc$_3$-1a | A$_d$ |
|  | 2 | 61 | 70 |  |  |
|  | 6 | 15 | 30 |  |  |
|  | 18 | 6 | 10 |  |  |
| 678381 | 0.6 | 105 | 90 | GalNAc$_3$-3a | A$_d$ |
|  | 2 | 53 | 60 |  |  |
|  | 6 | 16 | 20 |  |  |
|  | 18 | 7 | 13 |  |  |
| 678382 | 0.6 | 90 | 79 | GalNAc$_3$-7a | A$_d$ |
|  | 2 | 49 | 57 |  |  |
|  | 6 | 21 | 27 |  |  |
|  | 18 | 8 | 11 |  |  |
| 678383 | 0.6 | 94 | 84 | GalNAc$_3$-10a | A$_d$ |
|  | 2 | 44 | 53 |  |  |
|  | 6 | 13 | 24 |  |  |
|  | 18 | 6 | 10 |  |  |
| 678384 | 0.6 | 106 | 91 | GalNAc$_3$-13a | A$_d$ |
|  | 2 | 65 | 59 |  |  |
|  | 6 | 26 | 31 |  |  |
|  | 18 | 11 | 15 |  |  |

Liver transaminase and BUN levels in plasma were measured at time of sacrifice using standard protocols. Body weights and organ weights were also measured. The results are shown in Table 74 below. Body weight is shown as % relative to baseline. Organ weights are shown as % of body weight relative to the PBS control group.

TABLE 74

| ISIS No. | Dosage (mg/kg) | ALT (U/L) | AST (U/L) | BUN (mg/dL) | Body weight (% baseline) | Liver weight (Rel % BW) | Kidney weight (Rel % BW) | Spleen weight (Rel % BW) |
|---|---|---|---|---|---|---|---|---|
| PBS | n/a | 25 | 51 | 37 | 119 | 100 | 100 | 100 |
| 476366 | 5 | 34 | 68 | 35 | 116 | 91 | 98 | 106 |
|  | 15 | 37 | 74 | 30 | 122 | 92 | 101 | 128 |
|  | 45 | 30 | 47 | 31 | 118 | 99 | 108 | 123 |
| 656326 | 0.6 | 29 | 57 | 40 | 123 | 100 | 103 | 119 |
|  | 2 | 36 | 75 | 39 | 114 | 98 | 111 | 106 |
|  | 6 | 32 | 67 | 39 | 125 | 99 | 97 | 122 |
|  | 18 | 46 | 77 | 36 | 116 | 102 | 109 | 101 |
| 678381 | 0.6 | 26 | 57 | 32 | 117 | 93 | 109 | 110 |
|  | 2 | 26 | 52 | 33 | 121 | 96 | 106 | 125 |
|  | 6 | 40 | 78 | 32 | 124 | 92 | 106 | 126 |
|  | 18 | 31 | 54 | 28 | 118 | 94 | 103 | 120 |
| 678382 | 0.6 | 26 | 42 | 35 | 114 | 100 | 103 | 103 |
|  | 2 | 25 | 50 | 31 | 117 | 91 | 104 | 117 |
|  | 6 | 30 | 79 | 29 | 117 | 89 | 102 | 107 |
|  | 18 | 65 | 112 | 31 | 120 | 89 | 104 | 113 |
| 678383 | 0.6 | 30 | 67 | 38 | 121 | 91 | 100 | 123 |
|  | 2 | 33 | 53 | 33 | 118 | 98 | 102 | 121 |
|  | 6 | 32 | 63 | 32 | 117 | 97 | 105 | 105 |
|  | 18 | 36 | 68 | 31 | 118 | 99 | 103 | 108 |
| 678384 | 0.6 | 36 | 63 | 31 | 118 | 98 | 103 | 98 |
|  | 2 | 32 | 61 | 32 | 119 | 93 | 102 | 114 |
|  | 6 | 34 | 69 | 34 | 122 | 100 | 100 | 96 |
|  | 18 | 28 | 54 | 30 | 117 | 98 | 101 | 104 |

Example 81

Duration of Action In Vivo of Oligonucleotides Targeting A1AT Comprising a GalNAc$_3$ Cluster The oligonucleotides listed in Table 72 were tested in a single dose study for duration of action in mice.

Treatment

Six week old, male C57BL/6 mice were each injected subcutaneously once with an oligonucleotide listed in Table 72 or with PBS. Each treatment group consisted of 4 animals. Blood was drawn the day before dosing to determine baseline and at 5, 12, 19, and 25 days following the dose. Plasma A1AT protein levels were measured via ELISA (see Example 80). The results below are presented as the average percent of plasma A1AT protein levels for each treatment group, normalized to baseline levels. The results show that the oligonucleotides comprising a GalNAc conjugate were more potent and had longer duration of action than the parent lacking a GalNAc conjugate (ISIS 476366). Furthermore, the oligonucleotides comprising a 5'-GalNAc conjugate (ISIS 678381, 678382, 678383, and 678384) were generally even more potent with even longer duration of action than the oligonucleotide comprising a 3'-GalNAc conjugate (ISIS 656326).

TABLE 75

Plasma A1AT protein levels in mice

| ISIS No. | Dosage (mg/kg) | Time point (days post-dose) | A1AT (% baseline) | GalNAc$_3$ Cluster | CM |
|---|---|---|---|---|---|
| PBS | n/a | 5 | 93 | n/a | n/a |
|  |  | 12 | 93 |  |  |
|  |  | 19 | 90 |  |  |
|  |  | 25 | 97 |  |  |
| 476366 | 100 | 5 | 38 | n/a | n/a |
|  |  | 12 | 46 |  |  |
|  |  | 19 | 62 |  |  |
|  |  | 25 | 77 |  |  |
| 656326 | 18 | 5 | 33 | GalNAc$_3$-1a | A$_d$ |
|  |  | 12 | 36 |  |  |
|  |  | 19 | 51 |  |  |
|  |  | 25 | 72 |  |  |
| 678381 | 18 | 5 | 21 | GalNAc$_3$-3a | A$_d$ |
|  |  | 12 | 21 |  |  |
|  |  | 19 | 35 |  |  |
|  |  | 25 | 48 |  |  |
| 678382 | 18 | 5 | 21 | GalNAc$_3$-7a | A$_d$ |
|  |  | 12 | 21 |  |  |
|  |  | 19 | 39 |  |  |
|  |  | 25 | 60 |  |  |
| 678383 | 18 | 5 | 24 | GalNAc$_3$-10a | A$_d$ |
|  |  | 12 | 21 |  |  |
|  |  | 19 | 45 |  |  |
|  |  | 25 | 73 |  |  |
| 678384 | 18 | 5 | 29 | GalNAc$_3$-13a | A$_d$ |
|  |  | 12 | 34 |  |  |
|  |  | 19 | 57 |  |  |
|  |  | 25 | 76 |  |  |

Example 82

Antisense Inhibition In Vitro by Oligonucleotides Targeting SRB-1 Comprising a GalNAc$_3$ Conjugate Primary mouse liver hepatocytes were seeded in 96 well plates at 15,000 cells/well 2 hours prior to treatment. The oligonucleotides listed in Table 76 were added at 2, 10, 50, or 250 nM in Williams E medium and cells were incubated overnight at 37° C. in 5% CO$_2$. Cells were lysed 16 hours following oligonucleotide addition, and total RNA was purified using RNease 3000 BioRobot (Qiagen). SRB-1 mRNA levels were determined using real-time PCR and RIBOGREEN® RNA quantification reagent (Molecular Probes, Inc. Eugene, Oreg.) according to standard protocols. IC$_{50}$ values were determined using Prism 4 software (Graph-Pad). The results show that oligonucleotides comprising a variety of different GalNAc conjugate groups and a variety of different cleavable moieties are significantly more potent in an in vitro free uptake experiment than the parent oligonucleotides lacking a GalNAc conjugate group (ISIS 353382 and 666841).

TABLE 76

Inhibition of SRB-1 expression in vitro

| ISIS No. | Sequence (5' to 3') | Linkages | GalNAc cluster | CM | IC$_{50}$ (nM) | SEQ ID NO. |
|---|---|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | n/a | n/a | 250 | 108 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$,-GalNAc$_3$-1$_a$ | PS | GalNAc$_3$-1$_a$ | A$_d$ | 40 | 110 |
| 661161 | GalNAc$_3$-3$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | A$_d$ | 40 | 109 |
| 661162 | GalNAc$_3$-3$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-3$_a$ | A$_d$ | 8 | 109 |
| 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$,-GalNAc$_3$-1$_a$ | PS | GalNAc$_3$-9$_a$ | A$_d$ | 20 | 110 |
| 665001 | GalNAc$_3$-8$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-8$_a$ | A$_d$ | 70 | 109 |

TABLE 76-continued

Inhibition of SRB-1 expression in vitro

| ISIS No. | Sequence (5' to 3') | Linkages | GalNAc cluster | CM | IC$_{50}$ (nM) | SEQ ID NO. |
|---|---|---|---|---|---|---|
| 666224 | GalNAc$_3$-5$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-5$_a$ | A$_d$ | 80 | 109 |
| 666841 | G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | n/a | n/a | >250 | 108 |
| 666881 | GalNAc$_3$-10$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-10$_a$ | A$_d$ | 30 | 109 |
| 666904 | GalNAc$_3$-3$_{a-o'}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | PO | 9 | 108 |
| 666924 | GalNAc$_3$-3$_{a-o'}$T$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | T$_d$ | 15 | 123 |
| 666961 | GalNAc$_3$-6$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-6$_a$ | A$_d$ | 150 | 109 |
| 666981 | GalNAc$_3$-7$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-7$_a$ | A$_d$ | 20 | 109 |
| 670061 | GalNAc$_3$-13$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-13$_a$ | A$_d$ | 30 | 109 |
| 670699 | GalNAc$_3$-3$_{a-o'}$T$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-3$_a$ | T$_d$ | 15 | 116 |
| 670700 | GalNAc$_3$-3$_{a-o'}$A$_{eo}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-3$_a$ | A$_e$ | 30 | 109 |
| 670701 | GalNAc$_3$-3$_{a-o'}$T$_{eo}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-3$_a$ | T$_e$ | 25 | 116 |
| 671144 | GalNAc$_3$-3$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-12$_a$ | A$_d$ | 40 | 109 |
| 671165 | GalNAc$_3$-3$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-13$_a$ | A$_d$ | 8 | 109 |
| 671261 | GalNAc$_3$-14$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-14$_a$ | A$_d$ | >250 | 109 |
| 671262 | GalNAc$_3$-15$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-15$_a$ | A$_d$ | >250 | 109 |
| 673501 | GalNAc$_3$-7$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-7$_a$ | A$_d$ | 30 | 109 |
| 673502 | GalNAc$_3$-10$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-10$_a$ | A$_d$ | 8 | 109 |
| 675441 | GalNAc$_3$-17$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-17$_a$ | A$_d$ | 30 | 109 |
| 675442 | GalNAc$_3$-18$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-18$_a$ | A$_d$ | 20 | 109 |
| 677841 | G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-19$_a$ | PS | GalNAc$_3$-19$_a$ | A$_d$ | 40 | 110 |
| 677842 | G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-20$_a$ | PS | GalNAc$_3$-20$_a$ | A$_d$ | 30 | 110 |
| 677843 | GalNAc$_3$-23$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-23$_a$ | A$_d$ | 40 | 109 |

The structure of GalNAc$_3$-1$_a$ was shown previously in Example 9, GalNAc$_3$-3$_a$ was shown in Example 39, GalNAc$_3$-5$_a$ was shown in Example 49, GalNAc$_3$-6$_a$ was shown in Example 51, GalNAc$_3$-7$_a$ was shown in Example 48, GalNAc$_3$-8$_a$ was shown in Example 47, and GalNAc$_3$-9$_a$ was shown in Example 52, GalNAc$_3$-10$_a$ was shown in Example 46, GalNAc$_3$-12$_a$ was shown in Example 61, GalNAc$_3$-13$_a$ was shown in Example 62, GalNAc$_3$-14$_a$ was shown in Example 63, GalNAc$_3$-15$_a$ was shown in Example 64, and GalNAc$_3$-17$_a$ was shown in Example 68, GalNAc$_3$-18$_a$ was shown in Example 69, GalNAc$_3$-19$_a$ was shown in Example 70, GalNAc$_3$-20$_a$ was shown in Example 71, GalNAc$_3$-23$_a$ was shown in Example 76.

Example 83

Antisense Inhibition In Vivo by Oligonucleotides Targeting Factor XI Comprising a GalNAc₃ Cluster The oligonucleotides listed in Table 77 below were tested in a study for dose-dependent inhibition of Factor XI in mice.

TABLE 77

Modified olignucleotides targeting Factor XI

| ISIS No. | Sequences (5' to 3') | GalNAc₃ Cluster | CM | SEQ ID No. |
|---|---|---|---|---|
| 404071 | $T_{es}G_{es}G_{es}T_{es}A_{es}A_{ds}T_{ds}{}^mC_{ds}{}^mC_{ds}A_{ds}{}^mC_{ds}T_{ds}T_{ds}T_{ds}{}^mC_{ds}A_{es}G_{es}A_{es}G_{es}G_e$ | n/a | n/a | 115 |
| 656173 | $T_{es}G_{eo}G_{eo}T_{eo}A_{eo}A_{ds}T_{ds}{}^mC_{ds}{}^mC_{ds}A_{ds}{}^mC_{ds}T_{ds}T_{ds}T_{ds}{}^mC_{ds}A_{eo}G_{eo}A_{es}G_{es}G_{eo}A_{do'}$-GalNAc₃-1$_a$ | GalNAc₃-1$_a$ | A$_d$ | 113 |
| 663086 | GalNAc₃-3$_{a-o'}$A$_{do}$T$_{es}$G$_{eo}$G$_{eo}$T$_{eo}$A$_{eo}$A$_{ds}$T$_{ds}$${}^mC_{ds}$${}^mC_{ds}$A$_{ds}$${}^mC_{ds}$T$_{ds}$T$_{ds}$T$_{ds}$${}^mC_{ds}$A$_{eo}$G$_{eo}$A$_{es}$G$_{es}$G$_e$ | GalNAc₃-3$_a$ | A$_d$ | 124 |
| 678347 | GalNAc₃-7$_{a-o'}$A$_{do}$T$_{es}$G$_{eo}$G$_{eo}$T$_{eo}$A$_{eo}$A$_{ds}$T$_{ds}$${}^mC_{ds}$${}^mC_{ds}$A$_{ds}$${}^mC_{ds}$T$_{ds}$T$_{ds}$T$_{ds}$${}^mC_{ds}$A$_{es}$G$_{es}$A$_{es}$G$_{es}$G$_e$ | GalNAc₃-7$_a$ | A$_d$ | 124 |
| 678348 | GalNAc₃-10$_{a-o'}$A$_{do}$T$_{es}$G$_{eo}$G$_{eo}$T$_{eo}$A$_{eo}$A$_{ds}$T$_{ds}$${}^mC_{ds}$${}^mC_{ds}$A$_{ds}$${}^mC_{ds}$T$_{ds}$T$_{ds}$T$_{ds}$${}^mC_{ds}$A$_{eo}$G$_{eo}$A$_{es}$G$_{es}$G$_e$ | GalNAc₃-10$_a$ | A$_d$ | 124 |
| 678349 | GalNAc₃-13$_{a-o'}$A$_{do}$T$_{es}$G$_{eo}$G$_{eo}$T$_{eo}$A$_{eo}$A$_{ds}$T$_{ds}$${}^mC_{ds}$${}^mC_{ds}$A$_{ds}$${}^mC_{ds}$T$_{ds}$T$_{ds}$T$_{ds}$${}^mC_{ds}$A$_{eo}$G$_{eo}$A$_{es}$G$_{es}$G$_e$ | GalNAc₃-13$_a$ | A$_d$ | 124 |

The structure of GalNAc₃-1$_a$ was shown previously in Example 9, GalNAc₃-3$_a$ was shown in Example 39, GalNAc₃-7$_a$ was shown in Example 48, GalNAc₃-10$_a$ was shown in Example 46, GalNAc₃-13$_a$ was shown in Example 62.

Treatment

Six to eight week old mice were each injected subcutaneously once per week at a dosage shown below, for a total of three doses, with an oligonucleotide listed below or with PBS. Each treatment group consisted of 4 animals. The mice were sacrificed 72 hours following the final dose. Factor XI liver mRNA levels were measured using real-time PCR and normalized to cyclophilin according to standard protocols. Liver transaminases, BUN, and bilirubin were also measured. The results below are presented as the average percent for each treatment group, normalized to the PBS control.

As illustrated in Table 78, treatment with antisense oligonucleotides lowered Factor XI liver mRNA in a dose-dependent manner. The results show that the oligonucleotides comprising a GalNAc conjugate were more potent than the parent lacking a GalNAc conjugate (ISIS 404071). Furthermore, the oligonucleotides comprising a 5'-GalNAc conjugate (ISIS 663086, 678347, 678348, and 678349) were even more potent than the oligonucleotide comprising a 3'-GalNAc conjugate (ISIS 656173).

TABLE 78

Factor XI liver mRNA, liver transaminase, BUN, and bilirubin levels

| ISIS No. | Dosage (mg/kg) | Factor XI mRNA (% PBS) | ALT (U/L) | AST (U/L) | BUN (mg/dL) | Bilirubin (mg/dL) | GalNAc₃ Cluster | SEQ ID No. |
|---|---|---|---|---|---|---|---|---|
| PBS | n/a | 100 | 63 | 70 | 21 | 0.18 | n/a | n/a |
| 404071 | 3 | 65 | 41 | 58 | 21 | 0.15 | n/a | 115 |
|  | 10 | 33 | 49 | 53 | 23 | 0.15 |  |  |
|  | 30 | 17 | 43 | 57 | 22 | 0.14 |  |  |
| 656173 | 0.7 | 43 | 90 | 89 | 21 | 0.16 | GalNAc₃-1a | 113 |
|  | 2 | 9 | 36 | 58 | 26 | 0.17 |  |  |
|  | 6 | 3 | 50 | 63 | 25 | 0.15 |  |  |
| 663086 | 0.7 | 33 | 91 | 169 | 25 | 0.16 | GalNAc₃-3a | 124 |
|  | 2 | 7 | 38 | 55 | 21 | 0.16 |  |  |
|  | 6 | 1 | 34 | 40 | 23 | 0.14 |  |  |
| 678347 | 0.7 | 35 | 28 | 49 | 20 | 0.14 | GalNAc₃-7a | 124 |
|  | 2 | 10 | 180 | 149 | 21 | 0.18 |  |  |
|  | 6 | 1 | 44 | 76 | 19 | 0.15 |  |  |
| 678348 | 0.7 | 39 | 43 | 54 | 21 | 0.16 | GalNAc₃-10a | 124 |
|  | 2 | 5 | 38 | 55 | 22 | 0.17 |  |  |
|  | 6 | 2 | 25 | 38 | 20 | 0.14 |  |  |
| 678349 | 0.7 | 34 | 39 | 46 | 20 | 0.16 | GalNAc₃-13a | 124 |
|  | 2 | 8 | 43 | 63 | 21 | 0.14 |  |  |
|  | 6 | 2 | 28 | 41 | 20 | 0.14 |  |  |

Example 84

Duration of Action In Vivo of Oligonucleotides Targeting Factor XI Comprising a GalNAc$_3$ Conjugate The oligonucleotides listed in Table 77 were tested in a single dose study for duration of action in mice.

Treatment

Six to eight week old mice were each injected subcutaneously once with an oligonucleotide listed in Table 77 or with PBS. Each treatment group consisted of 4 animals. Blood was drawn by tail bleeds the day before dosing to determine baseline and at 3, 10, and 17 days following the dose. Plasma Factor XI protein levels were measured by ELISA using Factor XI capture and biotinylated detection antibodies from R & D Systems, Minneapolis, Minn. (catalog # AF2460 and # BAF2460, respectively) and the OptEIA Reagent Set B (Catalog #550534, BD Biosciences, San Jose, Calif.). The results below are presented as the average percent of plasma Factor XI protein levels for each treatment group, normalized to baseline levels. The results show that the oligonucleotides comprising a GalNAc conjugate were more potent with longer duration of action than the parent lacking a GalNAc conjugate (ISIS 404071). Furthermore, the oligonucleotides comprising a 5'-GalNAc conjugate (ISIS 663086, 678347, 678348, and 678349) were even more potent with an even longer duration of action than the oligonucleotide comprising a 3'-GalNAc conjugate (ISIS 656173).

TABLE 79

Plasma Factor XI protein levels in mice

| ISIS No. | Dosage (mg/kg) | Time point (days post-dose) | Factor XI (% baseline) | GalNAc$_3$ Cluster | CM | SEQ ID No. |
|---|---|---|---|---|---|---|
| PBS | n/a | 3 | 123 | n/a | n/a | n/a |
|  |  | 10 | 56 |  |  |  |
|  |  | 17 | 100 |  |  |  |
| 404071 | 30 | 3 | 11 | n/a | n/a | 115 |
|  |  | 10 | 47 |  |  |  |
|  |  | 17 | 52 |  |  |  |
| 656173 | 6 | 3 | 1 | GalNAc$_3$-1a | A$_d$ | 113 |
|  |  | 10 | 3 |  |  |  |
|  |  | 17 | 21 |  |  |  |
| 663086 | 6 | 3 | 1 | GalNAc$_3$-3a | A$_d$ | 124 |
|  |  | 10 | 2 |  |  |  |
|  |  | 17 | 9 |  |  |  |
| 678347 | 6 | 3 | 1 | GalNAc$_3$-7a | A$_d$ | 124 |
|  |  | 10 | 1 |  |  |  |
|  |  | 17 | 8 |  |  |  |
| 678348 | 6 | 3 | 1 | GalNAc$_3$-10a | A$_d$ | 124 |
|  |  | 10 | 1 |  |  |  |
|  |  | 17 | 6 |  |  |  |
| 678349 | 6 | 3 | 1 | GalNAc$_3$-13a | A$_d$ | 124 |
|  |  | 10 | 1 |  |  |  |
|  |  | 17 | 5 |  |  |  |

Example 85

Antisense Inhibition In Vivo by Oligonucleotides Targeting SRB-1 Comprising a GalNAc$_3$ Conjugate Oligonucleotides listed in Table 76 were tested in a dose-dependent study for antisense inhibition of SRB-1 in mice.

Treatment

Six to eight week old C57BL/6 mice were each injected subcutaneously once per week at a dosage shown below, for a total of three doses, with an oligonucleotide listed in Table 76 or with saline. Each treatment group consisted of 4 animals. The mice were sacrificed 48 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of liver SRB-1 mRNA levels for each treatment group, normalized to the saline control.

As illustrated in Tables 80 and 81, treatment with antisense oligonucleotides lowered SRB-1 mRNA levels in a dose-dependent manner

TABLE 80

SRB-1 mRNA in liver

| ISIS No. | Dosage (mg/kg) | SRB-1 mRNA (% Saline) | GalNAc$_3$ Cluster | CM |
|---|---|---|---|---|
| Saline | n/a | 100 | n/a | n/a |
| 655861 | 0.1 | 94 | GalNAc$_3$-1a | A$_d$ |
|  | 0.3 | 119 |  |  |
|  | 1 | 68 |  |  |
|  | 3 | 32 |  |  |
| 661161 | 0.1 | 120 | GalNAc$_3$-3a | A$_d$ |
|  | 0.3 | 107 |  |  |
|  | 1 | 68 |  |  |
|  | 3 | 26 |  |  |
| 666881 | 0.1 | 107 | GalNAc$_3$-10a | A$_d$ |
|  | 0.3 | 107 |  |  |
|  | 1 | 69 |  |  |
|  | 3 | 27 |  |  |
| 666981 | 0.1 | 120 | GalNAc$_3$-7a | A$_d$ |
|  | 0.3 | 103 |  |  |
|  | 1 | 54 |  |  |
|  | 3 | 21 |  |  |
| 670061 | 0.1 | 118 | GalNAc$_3$-13a | A$_d$ |
|  | 0.3 | 89 |  |  |
|  | 1 | 52 |  |  |
|  | 3 | 18 |  |  |
| 677842 | 0.1 | 119 | GalNAc$_3$-20a | A$_d$ |
|  | 0.3 | 96 |  |  |
|  | 1 | 65 |  |  |
|  | 3 | 23 |  |  |

TABLE 81

SRB-1 mRNA in liver

| ISIS No. | Dosage (mg/kg) | SRB-1 mRNA (% Saline) | GalNAc$_3$ Cluster | CM |
|---|---|---|---|---|
| 661161 | 0.1 | 107 | GalNAc$_3$-3a | A$_d$ |
|  | 0.3 | 95 |  |  |
|  | 1 | 53 |  |  |
|  | 3 | 18 |  |  |
| 677841 | 0.1 | 110 | GalNAc$_3$-19a | A$_d$ |
|  | 0.3 | 88 |  |  |
|  | 1 | 52 |  |  |
|  | 3 | 25 |  |  |

Liver transaminase levels, total bilirubin, BUN, and body weights were also measured using standard protocols. Average values for each treatment group are shown in Table 82 below.

TABLE 82

| ISIS No. | Dosage (mg/kg) | ALT (U/L) | AST (U/L) | Bilirubin (mg/dL) | BUN (mg/dL) | Body Weight (% baseline) | GalNAc$_3$ Cluster | CM |
|---|---|---|---|---|---|---|---|---|
| Saline | n/a | 19 | 39 | 0.17 | 26 | 118 | n/a | n/a |
| 655861 | 0.1 | 25 | 47 | 0.17 | 27 | 114 | GalNAc$_3$-1a | A$_d$ |
|  | 0.3 | 29 | 56 | 0.15 | 27 | 118 |  |  |
|  | 1 | 20 | 32 | 0.14 | 24 | 112 |  |  |
|  | 3 | 27 | 54 | 0.14 | 24 | 115 |  |  |
| 661161 | 0.1 | 35 | 83 | 0.13 | 24 | 113 | GalNAc$_3$-3a | A$_d$ |
|  | 0.3 | 42 | 61 | 0.15 | 23 | 117 |  |  |
|  | 1 | 34 | 60 | 0.18 | 22 | 116 |  |  |
|  | 3 | 29 | 52 | 0.13 | 25 | 117 |  |  |
| 666881 | 0.1 | 30 | 51 | 0.15 | 23 | 118 | GalNAc$_3$-10a | A$_d$ |
|  | 0.3 | 49 | 82 | 0.16 | 25 | 119 |  |  |
|  | 1 | 23 | 45 | 0.14 | 24 | 117 |  |  |
|  | 3 | 20 | 38 | 0.15 | 21 | 112 |  |  |
| 666981 | 0.1 | 21 | 41 | 0.14 | 22 | 113 | GalNAc$_3$-7a | A$_d$ |
|  | 0.3 | 29 | 49 | 0.16 | 24 | 112 |  |  |
|  | 1 | 19 | 34 | 0.15 | 22 | 111 |  |  |
|  | 3 | 77 | 78 | 0.18 | 25 | 115 |  |  |
| 670061 | 0.1 | 20 | 63 | 0.18 | 24 | 111 | GalNAc$_3$-13a | A$_d$ |
|  | 0.3 | 20 | 57 | 0.15 | 21 | 115 |  |  |
|  | 1 | 20 | 35 | 0.14 | 20 | 115 |  |  |
|  | 3 | 27 | 42 | 0.12 | 20 | 116 |  |  |
| 677842 | 0.1 | 20 | 38 | 0.17 | 24 | 114 | GalNAc$_3$-20a | A$_d$ |
|  | 0.3 | 31 | 46 | 0.17 | 21 | 117 |  |  |
|  | 1 | 22 | 34 | 0.15 | 21 | 119 |  |  |
|  | 3 | 41 | 57 | 0.14 | 23 | 118 |  |  |

Example 86

Antisense Inhibition In Vivo by Oligonucleotides Targeting TTR Comprising a GalNAc$_3$ Cluster Oligonucleotides listed in Table 83 below were tested in a dose-dependent study for antisense inhibition of human transthyretin (TTR) in transgenic mice that express the human TTR gene.

Treatment

Eight week old TTR transgenic mice were each injected subcutaneously once per week for three weeks, for a total of three doses, with an oligonucleotide and dosage listed in the tables below or with PBS. Each treatment group consisted of 4 animals. The mice were sacrificed 72 hours following the final administration. Tail bleeds were performed at various time points throughout the experiment, and plasma TTR protein, ALT, and AST levels were measured and reported in Tables 85-87. After the animals were sacrificed, plasma ALT, AST, and human TTR levels were measured, as were body weights, organ weights, and liver human TTR mRNA levels. TTR protein levels were measured using a clinical analyzer (AU480, Beckman Coulter, Calif.). Real-time PCR and RIBOGREEN® RNA quantification reagent (Molecular Probes, Inc. Eugene, Oreg.) were used according to standard protocols to determine liver human TTR mRNA levels. The results presented in Tables 84-87 are the average values for each treatment group. The mRNA levels are the average values relative to the average for the PBS group. Plasma protein levels are the average values relative to the average value for the PBS group at baseline. Body weights are the average percent weight change from baseline until sacrifice for each individual treatment group. Organ weights shown are normalized to the animal's body weight, and the average normalized organ weight for each treatment group is then presented relative to the average normalized organ weight for the PBS group.

In Tables 84-87, "BL" indicates baseline, measurements that were taken just prior to the first dose. As illustrated in Tables 84 and 85, treatment with antisense oligonucleotides lowered TTR expression levels in a dose-dependent manner. The oligonucleotides comprising a GalNAc conjugate were more potent than the parent lacking a GalNAc conjugate (ISIS 420915). Furthermore, the oligonucleotides comprising a GalNAc conjugate and mixed PS/PO internucleoside linkages were even more potent than the oligonucleotide comprising a GalNAc conjugate and full PS linkages.

TABLE 83

Olignucleotides targeting human TTR

| ISIS No. | Sequences (5' to 3') | Linkages | GalNAc$_3$ Cluster | CM | SEQ ID No. |
|---|---|---|---|---|---|
| 420915 | T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | PS | n/a | n/a | 74 |
| 660261 | T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$G$_{ds}$T$_{ds}$A$_{ds}$A$_{ds}$A$_{es}$T$_{es}$$^m$C$_{es}$$^m$C$_{es}$$^m$C$_{eo}$A$_{do}$'-GalNAc$_3$-1$_a$ | PS | GalNAc$_3$-1a | A$_d$ | 125 |
| 682883 | GalNAc$_3$-3$_a$-$_o$'T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | PS/PO | GalNAc$_3$-3a | PO | 74 |
| 682884 | GalNAc$_3$-7$_a$-$_o$'T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | PS/PO | GalNAc$_3$-7a | PO | 74 |
| 682885 | GalNAc$_3$-10$_a$-$_o$'T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | PS/PO | GalNAc$_3$-10a | PO | 74 |
| 682886 | GalNAc$_3$-13$_a$-$_o$'T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | PS/PO | GalNAc$_3$-13a | PO | 74 |

TABLE 83-continued

Oligonucleotides targeting human TTR

| ISIS No. | Sequences (5' to 3') | Link-ages | GalNAc$_3$ Cluster | SEQ ID CM No. |
|---|---|---|---|---|
| 684057 | T$_{es}$$^m$C$_{es}$T$_{es}$T$_{es}$G$_{es}$G$_{ds}$T$_{ds}$T$_{ds}$A$_{ds}$ C$_{ds}$A$_{ds}$G$_{ds}$T$_{ds}$A$_{ds}$A$_{ds}$A$_{es}$T$_{es}$$^m$C$_{es}$ $^m$C$_{es}$$^m$C$_{eo}$A$_{do}$,-GalNAc$_3$-19$_a$ | PS/PO | GalNAc$_3$-19a | A$_d$ 125 |

The legend for Table 85 can be found in Example 74.
The structure of GalNAc$_3$-1$_a$ was shown in Example 9.
The structure of GalNAc$_3$-3$_a$ was shown in Example 39.
The structure of GalNAc$_3$-7$_a$ was shown in Example 48.
The structure of GalNAc$_3$-10$_a$ was shown in Example 46.
The structure of GalNAc$_3$-13$_a$ was shown in Example 62.
The structure of GalNAc$_3$-19$_a$ was shown in Example 70.

TABLE 84

Antisense inhibition of human TTR in vivo

| Isis No. | Dosage (mg/kg) | TTR mRNA (% PBS) | Plasma TTR protein (% PBS) | GalNAc cluster | CM | SEQ ID No. |
|---|---|---|---|---|---|---|
| PBS | n/a | 100 | 100 | n/a | n/a | |
| 420915 | 6 | 99 | 95 | n/a | n/a | 74 |
|  | 20 | 48 | 65 | | | |
|  | 60 | 18 | 28 | | | |
| 660261 | 0.6 | 113 | 87 | GalNAc$_3$-1a | A$_d$ | 125 |
|  | 2 | 40 | 56 | | | |
|  | 6 | 20 | 27 | | | |
|  | 20 | 9 | 11 | | | |

TABLE 85

Antisense inhibition of human TTR in vivo

| Isis No. | Dosage (mg/kg) | TTR mRNA (% PBS) | Plasma TTR protein (% PBS at BL) BL | Day 3 | Day 10 | Day 17 (After sac) | GalNAc cluster | CM | SEQ ID No. |
|---|---|---|---|---|---|---|---|---|---|
| PBS | n/a | 100 | 100 | 96 | 90 | 114 | n/a | n/a | |
| 420915 | 6 | 74 | 106 | 86 | 76 | 83 | n/a | n/a | 74 |
|  | 20 | 43 | 102 | 66 | 61 | 58 | | | |
|  | 60 | 24 | 92 | 43 | 29 | 32 | | | |
| 682883 | 0.6 | 60 | 88 | 73 | 63 | 68 | GalNAc$_3$-3a | PO | 74 |
|  | 2 | 18 | 75 | 38 | 23 | 23 | | | |
|  | 6 | 10 | 80 | 35 | 11 | 9 | | | |
| 682884 | 0.6 | 56 | 88 | 78 | 63 | 67 | GalNAc$_3$-7a | PO | 74 |
|  | 2 | 19 | 76 | 44 | 25 | 23 | | | |
|  | 6 | 15 | 82 | 35 | 21 | 24 | | | |
| 682885 | 0.6 | 60 | 92 | 77 | 68 | 76 | GalNAc$_3$-10a | PO | 74 |
|  | 2 | 22 | 93 | 58 | 32 | 32 | | | |
|  | 6 | 17 | 85 | 37 | 25 | 20 | | | |
| 682886 | 0.6 | 57 | 91 | 70 | 64 | 69 | GalNAc$_3$-13a | PO | 74 |
|  | 2 | 21 | 89 | 50 | 31 | 30 | | | |
|  | 6 | 18 | 102 | 41 | 24 | 27 | | | |
| 684057 | 0.6 | 53 | 80 | 69 | 56 | 62 | GalNAc$_3$-19a | A$_d$ | 125 |
|  | 2 | 21 | 92 | 55 | 34 | 30 | | | |
|  | 6 | 11 | 82 | 50 | 18 | 13 | | | |

TABLE 86

Transaminase levels, body weight changes, and relative organ weights

| Isis No. | Dosage (mg/kg) | ALT (U/L) BL | Day 3 | Day 10 | Day 17 | AST (U/L) BL | Day 3 | Day 10 | Day 17 | Body (% BL) | Liver (% PBS) | Spleen (% PBS) | Kidney (% PBS) | SEQ ID No. |
|---|---|---|---|---|---|---|---|---|---|---|---|---|---|---|
| PBS | n/a | 33 | 34 | 33 | 24 | 58 | 62 | 67 | 52 | 105 | 100 | 100 | 100 | n/a |
| 420915 | 6 | 34 | 33 | 27 | 21 | 64 | 59 | 73 | 47 | 115 | 99 | 89 | 91 | 74 |
|  | 20 | 34 | 30 | 28 | 19 | 64 | 54 | 56 | 42 | 111 | 97 | 83 | 89 | |
|  | 60 | 34 | 35 | 31 | 24 | 61 | 58 | 71 | 58 | 113 | 102 | 98 | 95 | |
| 660261 | 0.6 | 33 | 38 | 28 | 26 | 70 | 71 | 63 | 59 | 111 | 96 | 99 | 92 | 125 |
|  | 2 | 29 | 32 | 31 | 34 | 61 | 60 | 68 | 61 | 118 | 100 | 92 | 90 | |
|  | 6 | 29 | 29 | 28 | 34 | 58 | 59 | 70 | 90 | 114 | 99 | 97 | 95 | |
|  | 20 | 33 | 32 | 28 | 33 | 64 | 54 | 68 | 95 | 114 | 101 | 106 | 92 | |

TABLE 87

Transaminase levels, body weight changes, and relative organ weights

| Isis No. | Dosage (mg/kg) | ALT (U/L) BL | ALT Day 3 | ALT Day 10 | ALT Day 17 | AST (U/L) BL | AST Day 3 | AST Day 10 | AST Day 17 | Body (% BL) | Liver (% PBS) | Spleen (% PBS) | Kidney (% PBS) | SEQ ID No. |
|---|---|---|---|---|---|---|---|---|---|---|---|---|---|---|
| PBS | n/a | 32 | 34 | 37 | 41 | 62 | 78 | 76 | 77 | 104 | 100 | 100 | 100 | n/a |
| 420915 | 6 | 32 | 30 | 34 | 34 | 61 | 71 | 72 | 66 | 102 | 103 | 102 | 105 | 74 |
|  | 20 | 41 | 34 | 37 | 33 | 80 | 76 | 63 | 54 | 106 | 107 | 135 | 101 |  |
|  | 60 | 36 | 30 | 32 | 34 | 58 | 81 | 57 | 60 | 106 | 105 | 104 | 99 |  |
| 682883 | 0.6 | 32 | 35 | 38 | 40 | 53 | 81 | 74 | 76 | 104 | 101 | 112 | 95 | 74 |
|  | 2 | 38 | 39 | 42 | 43 | 71 | 84 | 70 | 77 | 107 | 98 | 116 | 99 |  |
|  | 6 | 35 | 35 | 41 | 38 | 62 | 79 | 103 | 65 | 105 | 103 | 143 | 97 |  |
| 682884 | 0.6 | 33 | 32 | 35 | 34 | 70 | 74 | 75 | 67 | 101 | 100 | 130 | 99 | 74 |
|  | 2 | 31 | 32 | 38 | 38 | 63 | 77 | 66 | 55 | 104 | 103 | 122 | 100 |  |
|  | 6 | 38 | 32 | 36 | 34 | 65 | 85 | 80 | 62 | 99 | 105 | 129 | 95 |  |
| 682885 | 0.6 | 39 | 26 | 37 | 35 | 63 | 63 | 77 | 59 | 100 | 109 | 109 | 112 | 74 |
|  | 2 | 30 | 26 | 38 | 40 | 54 | 56 | 71 | 72 | 102 | 98 | 111 | 102 |  |
|  | 6 | 27 | 27 | 34 | 35 | 46 | 52 | 56 | 64 | 102 | 98 | 113 | 96 |  |
| 682886 | 0.6 | 30 | 40 | 34 | 36 | 58 | 87 | 54 | 61 | 104 | 99 | 120 | 101 | 74 |
|  | 2 | 27 | 26 | 34 | 36 | 51 | 55 | 55 | 69 | 103 | 91 | 105 | 92 |  |
|  | 6 | 40 | 28 | 34 | 37 | 107 | 54 | 61 | 69 | 109 | 100 | 102 | 99 |  |
| 684057 | 0.6 | 35 | 26 | 33 | 39 | 56 | 51 | 51 | 69 | 104 | 99 | 110 | 102 | 125 |
|  | 2 | 33 | 32 | 31 | 40 | 54 | 57 | 56 | 87 | 103 | 100 | 112 | 97 |  |
|  | 6 | 39 | 33 | 35 | 40 | 67 | 52 | 55 | 92 | 98 | 104 | 121 | 108 |  |

Example 87

Duration of Action In Vivo by Single Closes of Oligonucleotides Targeting TTR Comprising a GalNAc₃ Cluster ISIS numbers 420915 and 660261 (see Table 83) were tested in a single dose study for duration of action in mice. ISIS numbers 420915, 682883, and 682885 (see Table 83) were also tested in a single dose study for duration of action in mice.

Treatment

Eight week old, male transgenic mice that express human TTR were each injected subcutaneously once with 100 mg/kg ISIS No. 420915 or 13.5 mg/kg ISIS No. 660261. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 88

Plasma TTR protein levels

| ISIS No. | Dosage (mg/kg) | Time point (days post-dose) | TTR (% baseline) | GalNAc₃ Cluster | CM | SEQ ID No. |
|---|---|---|---|---|---|---|
| 420915 | 100 | 3 | 30 | n/a | n/a | 74 |
|  |  | 7 | 23 |  |  |  |
|  |  | 10 | 35 |  |  |  |
|  |  | 17 | 53 |  |  |  |
|  |  | 24 | 75 |  |  |  |
|  |  | 39 | 100 |  |  |  |
| 660261 | 13.5 | 3 | 27 | GalNAc₃-1a | $A_d$ | 125 |
|  |  | 7 | 21 |  |  |  |
|  |  | 10 | 22 |  |  |  |
|  |  | 17 | 36 |  |  |  |
|  |  | 24 | 48 |  |  |  |
|  |  | 39 | 69 |  |  |  |

Treatment

Female transgenic mice that express human TTR were each injected subcutaneously once with 100 mg/kg ISIS No. 420915, 10.0 mg/kg ISIS No. 682883, or 10.0 mg/kg 682885. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 89

Plasma TTR protein levels

| ISIS No. | Dosage (mg/kg) | Time point (days post-dose) | TTR (% baseline) | GalNAc₃ Cluster | CM | SEQ ID No. |
|---|---|---|---|---|---|---|
| 420915 | 100 | 3 | 48 | n/a | n/a | 74 |
|  |  | 7 | 48 |  |  |  |
|  |  | 10 | 48 |  |  |  |
|  |  | 17 | 66 |  |  |  |
|  |  | 31 | 80 |  |  |  |
| 682883 | 10.0 | 3 | 45 | GalNAc₃-3a | PO | 74 |
|  |  | 7 | 37 |  |  |  |
|  |  | 10 | 38 |  |  |  |
|  |  | 17 | 42 |  |  |  |
|  |  | 31 | 65 |  |  |  |
| 682885 | 10.0 | 3 | 40 | GalNAc₃-10a | PO | 74 |
|  |  | 7 | 33 |  |  |  |
|  |  | 10 | 34 |  |  |  |
|  |  | 17 | 40 |  |  |  |
|  |  | 31 | 64 |  |  |  |

The results in Tables 88 and 89 show that the oligonucleotides comprising a GalNAc conjugate are more potent with a longer duration of action than the parent oligonucleotide lacking a conjugate (ISIS 420915).

Example 88

Splicing Modulation In Vivo by Oligonucleotides Targeting SMN Comprising a GalNAc$_3$ Conjugate The oligonucleotides listed in Table 90 were tested for splicing modulation of human survival of motor neuron (SMN) in mice.

TABLE 90

Modified ASOSs targeting SMN

| ISIS No. | Sequences (5' to 3') | GalNAc$_3$ Cluster | CM | SEQ ID No. |
|---|---|---|---|---|
| 387954 | A$_{es}$T$_{es}$T$_{es}$$^m$C$_{es}$A$_{es}$$^m$C$_{es}$T$_{es}$T$_{es}$T$_{es}$$^m$ C$_{es}$A$_{es}$T$_{es}$A$_{es}$A$_{es}$T$_{es}$G$_{es}$$^m$C$_{es}$ T$_{es}$G$_{es}$G$_e$ | n/a | n/a | 126 |
| 699819 | GalNAc$_3$-7$_a$-$_o$,A$_{es}$T$_{es}$T$_{es}$$^m$C$_{es}$A$_{es}$$^m$ C$_{es}$T$_{es}$T$_{es}$T$_{es}$$^m$C$_{es}$A$_{es}$T$_{es}$A$_{es}$A$_{es}$T$_{es}$ G$_{es}$$^m$C$_{es}$T$_{es}$G$_{es}$G$_e$ | GalNAc$_3$-7a | PO | 126 |
| 699821 | GalNAc$_3$-7$_a$-$_o$,A$_{es}$T$_{eo}$T$_{eo}$$^m$C$_{eo}$A$_{eo}$$^m$ C$_{eo}$T$_{eo}$T$_{eo}$T$_{eo}$$^m$C$_{eo}$A$_{eo}$T$_{eo}$A$_{eo}$A$_{eo}$T$_{eo}$ G$_{eo}$$^m$C$_{eo}$T$_{es}$G$_{es}$G$_e$ | GalNAc$_3$-7a | PO | 126 |
| 700000 | A$_{es}$T$_{es}$T$_{es}$$^m$C$_{es}$A$_{es}$$^m$C$_{es}$T$_{es}$T$_{es}$T$_{es}$$^m$ C$_{es}$A$_{es}$T$_{es}$A$_{es}$A$_{es}$T$_{es}$G$_{es}$$^m$C$_{es}$T$_{es}$ G$_{es}$G$_{eo}$A$_{do}$,-GalNAc$_3$-1$_a$ | GalNAc$_3$-1a | A$_d$ | 127 |
| 703421 | X-ATT$^m$CA$^m$CTTT$^m$CATAATG-$^m$CTGG | n/a | n/a | 126 |
| 703422 | GalNAc$_3$-7$_b$-X-ATT$^m$CA$^m$CTTT$^m$ CATAATG$^m$CTGG | GalNAc$_3$-7b | n/a | 126 |

The structure of GalNAc$_3$-7$_a$ was shown in Example 48.

"X" indicates a 5' primary amine generated by Gene Tools (Philomath, OR), and GalNAc$_3$-7$_b$ indicated the structure of GalNAc$_3$-7$_a$ lacking the —NH—C$_6$—O portion of the linker as shown below:

ISIS numbers 703421 and 703422 are morphlino oligonucleotides, wherein each nucleotide of the two oligonucleotides is a morpholino nucleotide.

Treatment

Six week old transgenic mice that express human SMN were injected subcutaneously once with an oligonucleotide listed in Table 91 or with saline. Each treatment group consisted of 2 males and 2 females. The mice were sacrificed 3 days following the dose to determine the liver human SMN mRNA levels both with and without exon 7 using real-time PCR according to standard protocols. Total RNA was measured using Ribogreen reagent. The SMN mRNA levels were normalized to total mRNA, and further normalized to the averages for the saline treatment group. The resulting average ratios of SMN mRNA including exon 7 to SMN mRNA missing exon 7 are shown in Table 91. The results show that fully modified oligonucleotides that modulate splicing and comprise a GalNAc conjugate are significantly more potent in altering splicing in the liver than the parent oligonucleotides lacking a GlaNAc conjugate. Furthermore, this trend is maintained for multiple modification chemistries, including 2'-MOE and morpholino modified oligonucleotides.

TABLE 91

Effect of oligonucleotides targeting human SMN in vivo

| ISIS No. | Dose (mg/kg) | +Exon 7/−Exon 7 | GalNAc$_3$ Cluster | CM | SEQ ID No. |
|---|---|---|---|---|---|
| Saline | n/a | 1.00 | n/a | n/a | n/a |
| 387954 | 32 | 1.65 | n/a | n/a | 126 |
| 387954 | 288 | 5.00 | n/a | n/a | 126 |
| 699819 | 32 | 7.84 | GalNAc$_3$-7a | PO | 126 |
| 699821 | 32 | 7.22 | GalNAc$_3$-7a | PO | 126 |
| 700000 | 32 | 6.91 | GalNAc$_3$-1a | A$_d$ | 127 |
| 703421 | 32 | 1.27 | n/a | n/a | 126 |
| 703422 | 32 | 4.12 | GalNAc$_3$-7b | n/a | 126 |

Example 89

Antisense Inhibition In Vivo by Oligonucleotides Targeting Apolipoprotein a (Apo(a)) Comprising a GalNAc$_3$ Conjugate The oligonucleotides listed in Table 92 below were tested in a study for dose-dependent inhibition of Apo(a) in transgenic mice.

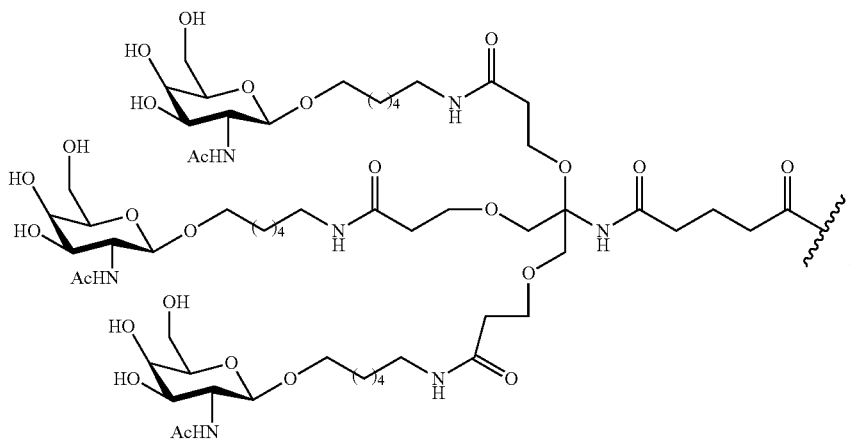

TABLE 92

Modified ASOs targeting Apo(a)

| ISIS No. | Sequences (5' to 3') | GalNAc₃ Cluster | CM | SEQ ID No. |
|---|---|---|---|---|
| 494372 | T$_{es}$G$_{es}$$^m$C$_{es}$T$_{es}$$^m$C$_{es}$$^m$G$_{ds}$T$_{ds}$T$_{ds}$G$_{ds}$ G$_{ds}$T$_{ds}$G$_{ds}$$^m$C$_{ds}$T$_{ds}$T$_{es}$G$_{es}$T$_{es}$T$_{es}$$^m$C$_e$ | n/a | n/a | 25 |
| 681257 | GalNAc3-7a-o'T$_{es}$G$_{eo}$$^m$C$_{eo}$T$_{eo}$$^m$ C$_{eo}$$^m$C$_{ds}$G$_{ds}$T$_{ds}$T$_{ds}$G$_{ds}$G$_{ds}$T$_{ds}$G$_{ds}$$^m$ C$_{ds}$T$_{ds}$T$_{eo}$G$_{eo}$T$_{es}$T$_{es}$$^m$C$_e$ | GalNAc₃-7a | PO | 25 |

The structure of GalNAc₃-7$_a$ was shown in Example 48.

Treatment

Eight week old, female C57BL/6 mice (Jackson Laboratory, Bar Harbor, Me.) were each injected subcutaneously once per week at a dosage shown below, for a total of six doses, with an oligonucleotide listed in Table 92 or with PBS. Each treatment group consisted of 3-4 animals. Tail bleeds were performed the day before the first dose and weekly following each dose to determine plasma Apo(a) protein levels. The mice were sacrificed two days following the final administration. Apo(a) liver mRNA levels were determined using real-time PCR and RIBOGREEN® RNA quantification reagent (Molecular Probes, Inc. Eugene, Oreg.) according to standard protocols. Apo(a) plasma protein levels were determined using ELISA, and liver transaminase levels were determined. The mRNA and plasma protein results in Table 93 are presented as the treatment group average percent relative to the PBS treated group. Plasma protein levels were further normalized to the baseline (BL) value for the PBS group. Average absolute transaminase levels and body weights (% relative to baseline averages) are reported in Table 94.

As illustrated in Table 93, treatment with the oligonucleotides lowered Apo(a) liver mRNA and plasma protein levels in a dose-dependent manner. Furthermore, the oligonucleotide comprising the GalNAc conjugate was significantly more potent with a longer duration of action than the parent oligonucleotide lacking a GalNAc conjugate. As illustrated in Table 94, transaminase levels and body weights were unaffected by the oligonucleotides, indicating that the oligonucleotides were well tolerated.

TABLE 93

Apo(a) liver mRNA and plasma protein levels

| ISIS No. | Dosage (mg/kg) | Apo(a) mRNA (% PBS) | Apo(a) plasma protein (% PBS) | | | | | |
|---|---|---|---|---|---|---|---|---|
| | | | BL | Week 1 | Week 2 | Week 3 | Week 4 | Week 5 | Week 6 |
| PBS | n/a | 100 | 100 | 120 | 119 | 113 | 88 | 121 | 97 |
| 494372 | 3 | 80 | 84 | 89 | 91 | 98 | 87 | 87 | 79 |
| | 10 | 30 | 87 | 72 | 76 | 71 | 57 | 59 | 46 |
| | 30 | 5 | 92 | 54 | 28 | 10 | 7 | 9 | 7 |
| 681257 | 0.3 | 75 | 79 | 76 | 89 | 98 | 71 | 94 | 78 |
| | 1 | 19 | 79 | 88 | 66 | 60 | 54 | 32 | 24 |
| | 3 | 2 | 82 | 52 | 17 | 7 | 4 | 6 | 5 |
| | 10 | 2 | 79 | 17 | 6 | 3 | 2 | 4 | 5 |

TABLE 94

| ISIS No. | Dosage (mg/kg) | ALT (U/L) | AST (U/L) | Body weight (% baseline) |
|---|---|---|---|---|
| PBS | n/a | 37 | 54 | 103 |
| 494372 | 3 | 28 | 68 | 106 |

TABLE 94-continued

| ISIS No. | Dosage (mg/kg) | ALT (U/L) | AST (U/L) | Body weight (% baseline) |
|---|---|---|---|---|
| | 10 | 22 | 55 | 102 |
| | 30 | 19 | 48 | 103 |
| 681257 | 0.3 | 30 | 80 | 104 |
| | 1 | 26 | 47 | 105 |
| | 3 | 29 | 62 | 102 |
| | 10 | 21 | 52 | 107 |

Example 90

Antisense Inhibition In Vivo by Oligonucleotides Targeting TTR Comprising a GalNAc₃ Cluster Oligonucleotides listed in Table 95 below were tested in a dose-dependent study for antisense inhibition of human transthyretin (TTR) in transgenic mice that express the human TTR gene.

Treatment

TTR transgenic mice were each injected subcutaneously once per week for three weeks, for a total of three doses, with an oligonucleotide and dosage listed in Table 96 or with PBS. Each treatment group consisted of 4 animals. Prior to the first dose, a tail bleed was performed to determine plasma TTR protein levels at baseline (BL). The mice were sacrificed 72 hours following the final administration. TTR protein levels were measured using a clinical analyzer (AU480, Beckman Coulter, Calif.). Real-time PCR and RIBOGREEN® RNA quantification reagent (Molecular Probes, Inc. Eugene, Oreg.) were used according to standard protocols to determine liver human TTR mRNA levels. The results presented in Table 96 are the average values for each treatment group. The mRNA levels are the average values relative to the average for the PBS group. Plasma protein levels are the average values relative to the average value for the PBS group at baseline. "BL" indicates baseline, measurements that were taken just prior to the first dose. As illustrated in Table 96, treatment with antisense oligonucleotides lowered TTR expression levels in a dose-dependent manner. The oligonucleotides comprising a GalNAc conjugate were more potent than the parent lacking a GalNAc conjugate (ISIS 420915), and oligonucleotides comprising a phosphodiester or deoxyadenosine cleavable moiety showed significant improvements in potency compared to the parent lacking a conjugate (see ISIS numbers 682883 and 666943 vs 420915 and see Examples 86 and 87).

TABLE 95

Oligonucleotides targeting human TTR

| Isis No. | Sequence 5' to 3' | Linkages | GalNAc cluster | CM | SEQ ID No. |
|---|---|---|---|---|---|
| 420915 | $T_{es}{}^mC_{es}T_{es}T_{es}G_{es}G_{ds}T_{ds}T_{ds}A_{ds}{}^mC_{ds}$ $A_{ds}T_{ds}G_{ds}A_{ds}A_{ds}A_{es}T_{es}{}^mC_{es}{}^mC_{es}{}^mC_e$ | PS | n/a | n/a | 74 |
| 682883 | GalNAc$_3$-3$_{a-o}$, $T_{es}{}^mC_{eo}T_{eo}T_{eo}G_{eo}$ $G_{ds}T_{ds}T_{ds}A_{ds}{}^mC_{ds}A_{ds}T_{ds}G_{ds}A_{ds}A_{ds}$ $A_{eo}T_{eo}{}^mC_{es}{}^mC_{es}{}^mC_e$ | PS/PO | GalNAc$_3$-3a | PO | 74 |
| 666943 | GalNAc$_3$-3$_{a-o}$, $A_{do}T_{es}{}^mC_{eo}T_{eo}T_{eo}$ $G_{eo}G_{ds}T_{ds}T_{ds}A_{ds}{}^mC_{ds}A_{ds}A_{ds}T_{ds}G_{ds}A_{ds}$ $A_{ds}A_{eo}T_{eo}{}^mC_{es}{}^mC_{es}{}^mC_e$ | PS/PO | GalNAc$_3$-3a | A$_d$ | 128 |
| 682887 | GalNAc$_3$-7$_{a-o}$, $A_{do}T_{es}{}^mC_{eo}T_{eo}T_{eo}$ $G_{eo}G_{ds}T_{ds}T_{ds}A_{ds}{}^mC_{ds}A_{ds}A_{ds}T_{ds}G_{ds}A_{ds}$ $A_{ds}A_{eo}T_{eo}{}^mC_{es}{}^mC_{es}{}^mC_e$ | PS/PO | GalNAc$_3$-7a | A$_d$ | 128 |
| 682888 | GalNAc$_3$-10$_{a-o}$, $A_{do}T_{es}{}^mC_{eo}T_{eo}$ $T_{eo}G_{eo}G_{ds}T_{ds}T_{ds}A_{ds}{}^mC_{ds}A_{ds}T_{ds}G_{ds}$ $A_{ds}A_{ds}A_{eo}T_{eo}{}^mC_{es}{}^mC_{es}{}^mC_e$ | PS/PO | GalNAc$_3$-10a | A$_d$ | 128 |
| 682889 | GalNAc$_3$-13$_{a-o}$, $A_{do}T_{es}{}^mC_{eo}T_{eo}$ $T_{eo}G_{eo}G_{ds}T_{ds}T_{ds}A_{ds}{}^mC_{ds}A_{ds}A_{ds}T_{ds}G_{ds}$ $A_{ds}A_{ds}A_{eo}T_{eo}{}^mC_{es}{}^mC_{es}{}^mC_e$ | PS/PO | GalNAc$_3$-13a | A$_d$ | 128 |

The legend for Table 95 can be found in Example 74.
The structure of GalNAc$_3$-3$_a$ was shown in Example 39.
The structure of GalNAc$_3$-7$_a$ was shown in Example 48.
The structure of GalNAc$_3$-10$_a$ was shown in Example 46.
The structure of GalNAc$_3$-13$_a$ was shown in Example 62.

TABLE 96

Antisense inhibition of human TTR in vivo

| Isis No. | Dosage (mg/kg) | TTR mRNA (% PBS) | TTR protein (% BL) | GalNAc cluster | CM |
|---|---|---|---|---|---|
| PBS | n/a | 100 | 124 | n/a | n/a |
| 420915 | 6 | 69 | 114 | n/a | n/a |
|  | 20 | 71 | 86 |  |  |
|  | 60 | 21 | 36 |  |  |
| 682883 | 0.6 | 61 | 73 | GalNAc$_3$-3a | PO |
|  | 2 | 23 | 36 |  |  |
|  | 6 | 18 | 23 |  |  |
| 666943 | 0.6 | 74 | 93 | GalNAc$_3$-3a | A$_d$ |
|  | 2 | 33 | 57 |  |  |
|  | 6 | 17 | 22 |  |  |
| 682887 | 0.6 | 60 | 97 | GalNAc$_3$-7a | A$_d$ |
|  | 2 | 36 | 49 |  |  |
|  | 6 | 12 | 19 |  |  |
| 682888 | 0.6 | 65 | 92 | GalNAc$_3$-10a | A$_d$ |
|  | 2 | 32 | 46 |  |  |
|  | 6 | 17 | 22 |  |  |
| 682889 | 0.6 | 72 | 74 | GalNAc$_3$-13a | A$_d$ |
|  | 2 | 38 | 45 |  |  |
|  | 6 | 16 | 18 |  |  |

Example 91

Antisense Inhibition In Vivo by Oligonucleotides Targeting Factor VII Comprising a GalNAc$_3$ Conjugate in Non-Human Primates Oligonucleotides listed in Table 97 below were tested in a non-terminal, dose escalation study for antisense inhibition of Factor VII in monkeys.

Treatment

Non-naïve monkeys were each injected subcutaneously on days 0, 15, and 29 with escalating doses of an oligonucleotide listed in Table 97 or with PBS. Each treatment group consisted of 4 males and 1 female. Prior to the first dose and at various time points thereafter, blood draws were performed to determine plasma Factor VII protein levels. Factor VII protein levels were measured by ELISA. The results presented in Table 98 are the average values for each treatment group relative to the average value for the PBS group at baseline (BL), the measurements taken just prior to the first dose. As illustrated in Table 98, treatment with antisense oligonucleotides lowered Factor VII expression levels in a dose-dependent manner, and the oligonucleotide comprising the GalNAc conjugate was significantly more potent in monkeys compared to the oligonucleotide lacking a GalNAc conjugate.

TABLE 97

Oligonucleotides targeting Factor VII

| Isis No. | Sequence 5' to 3' | Linkages | GalNAc cluster | CM | SEQ ID No. |
|---|---|---|---|---|---|
| 407935 | $A_{es}T_{es}G_{es}{}^mC_{es}A_{es}T_{ds}G_{ds}G_{ds}T_{ds}G_{ds}$ $A_{ds}T_{ds}G_{ds}{}^mC_{ds}T_{ds}T_{es}{}^mC_{es}T_{es}G_{es}A_e$ | PS | n/a | n/a | 38 |

TABLE 97-continued

Oligonucleotides targeting Factor VII

| Isis No. | Sequence 5' to 3' | Linkages | GalNAc cluster | CM | SEQ ID No. |
|---|---|---|---|---|---|
| 686892 | GalNAc$_3$-10$_{a-o}$,A$_{es}$T$_{es}$G$_{es}$$^m$C$_{es}$A$_{es}$ T$_{ds}$G$_{ds}$G$_{ds}$T$_{ds}$G$_{ds}$A$_{ds}$T$_{ds}$G$_{ds}$$^m$C$_{ds}$T$_{ds}$ T$_{es}$$^m$C$_{es}$T$_{es}$G$_{es}$A$_e$ | PS | GalNAc$_3$-10a | PO | 38 |

The legend for Table 97 can be found in Example 74.
The structure of GalNAc$_3$-10$_a$ was shown in Example 46.

TABLE 98

Factor VII plasma protein levels

| ISIS No. | Day | Dose (mg/kg) | Factor VII (% BL) |
|---|---|---|---|
| 407935 | 0 | n/a | 100 |
|  | 15 | 10 | 87 |
|  | 22 | n/a | 92 |
|  | 29 | 30 | 77 |
|  | 36 | n/a | 46 |
|  | 43 | n/a | 43 |
| 686892 | 0 | 3 | 100 |
|  | 15 | 10 | 56 |
|  | 22 | n/a | 29 |
|  | 29 | 30 | 19 |
|  | 36 | n/a | 15 |
|  | 43 | n/a | 11 |

Example 92

Antisense Inhibition in Primary Hepatocytes by Antisense Oligonucleotides Targeting ApoCIII Comprising a GalNAc$_3$ Conjugate Primary mouse hepatocytes were seeded in 96-well plates at 15,000 cells per well, and the oligonucleotides listed in Table 99, targeting mouse ApoC-III, were added at 0.46, 1.37, 4.12, or 12.35, 37.04, 111.11, or 333.33 nM or 1.00 µM. After incubation with the oligonucleotides for 24 hours, the cells were lysed and total RNA was purified using RNeasy (Qiagen). ApoC-III mRNA levels were determined using real-time PCR and RIBOGREEN® RNA quantification reagent (Molecular Probes, Inc.) according to standard protocols. IC$_{50}$ values were determined using Prism 4 software (GraphPad). The results show that regardless of whether the cleavable moiety was a phosphodiester or a phosphodiester-linked deoxyadensoine, the oligonucleotides comprising a GalNAc conjugate were significantly more potent than the parent oligonucleotide lacking a conjugate.

TABLE 99

Inhibition of mouse APOC-III expression in mouse primary hepatocytes

| ISIS No. | Sequence (5' to 3') | CM | IC$_{50}$ (nM) | SEQ ID No. |
|---|---|---|---|---|
| 440670 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_e$ | n/a | 13.20 | 129 |
| 661180 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_{eo}$A$_{do}$,-GalNAc$_3$-1$_a$ | A$_d$ | 1.40 | 130 |
| 680771 | GalNAc$_3$-3$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$ G$_{ds}$G$_{ds}$G$_{ds}$A$_{ds}$$^m$C$_{es}$A$_{es}$G$_{es}$$^m$C$_{es}$A$_e$ | PO | 0.70 | 129 |
| 680772 | GalNAc$_3$-7$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$ G$_{ds}$G$_{ds}$G$_{ds}$A$_{ds}$$^m$C$_{es}$A$_{es}$G$_{es}$$^m$C$_{es}$A$_e$ | PO | 1.70 | 129 |
| 680773 | GalNAc$_3$-10$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$ A$_{ds}$G$_{ds}$G$_{ds}$G$_{ds}$A$_{ds}$$^m$C$_{es}$A$_{es}$G$_{es}$$^m$C$_{es}$A$_e$ | PO | 2.00 | 129 |
| 680774 | GalNAc$_3$-13$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$ A$_{ds}$G$_{ds}$G$_{ds}$G$_{ds}$A$_{ds}$$^m$C$_{es}$A$_{es}$G$_{es}$$^m$C$_{es}$A$_e$ | PO | 1.50 | 129 |
| 681272 | GalNAc$_3$-3$_{a-o}$,$^m$C$_{es}$A$_{eo}$G$_{eo}$$^m$C$_{eo}$T$_{eo}$T$_{ds}$T$_{ds}$A$_{ds}$T$_{ds}$T$_{ds}$A$_{ds}$ G$_{ds}$G$_{ds}$G$_{ds}$A$_{ds}$$^m$C$_{eo}$A$_{eo}$G$_{es}$$^m$C$_{es}$A$_e$ | PO | <0.46 | 129 |
| 681273 | GalNAc$_3$-3$_{a-o}$,A$_{do}$$^m$C$_{es}$A$_{es}$G$_{es}$$^m$C$_{es}$T$_{es}$T$_{ds}$T$_{ds}$A$_{ds}$T$_{ds}$T$_{ds}$ A$_{ds}$G$_{ds}$G$_{ds}$G$_{ds}$A$_{ds}$$^m$C$_{es}$A$_{es}$G$_{es}$$^m$C$_{es}$A$_e$ | A$_d$ | 1.101 | 31 |
| 683733 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$ A$_{es}$G$_{es}$$^m$C$_{es}$A$_{eo}$A$_{do}$,-GalNAc$_3$-19$_a$ | A$_d$ | 2.50 | 130 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, GalNAc$_3$-13$_a$ was shown in Example 62, and GalNAc$_3$-19$_a$ was shown in Example 70.

Example 93

Antisense Inhibition In Vivo by Oligonucleotides Targeting SRB-1 Comprising Mixed Wings and a 5'-GalNAc$_3$ Conjugate The oligonucleotides listed in Table 100 were tested in a dose-dependent study for antisense inhibition of SRB-1 in mice.

TABLE 100

Modified ASOs targeting SRB-1

| ISIS No. | Sequences (5' to 3') | GalNAc$_3$ Cluster | CM | SEQ ID No. |
|---|---|---|---|---|
| 449093 | T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_k$ | n/a | n/a | 132 |
| 699806 | GalNAc$_3$-3$_{a-o'}$T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_k$ | GalNAc$_3$-3a | PO | 132 |
| 699807 | GalNAc$_3$-7$_{a-o'}$T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_k$ | GalNAc$_3$-7a | PO | 132 |
| 699809 | GalNAc$_3$-7$_{a-o'}$T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_e$ | GalNAc$_3$-7a | PO | 132 |
| 699811 | GalNAc$_3$-7$_{a-o'}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_k$ | GalNAc$_3$-7a | PO | 132 |
| 699813 | GalNAc$_3$-7$_{a-o'}$T$_{ks}$T$_{ds}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ds}$$^m$C$_k$ | GalNAc$_3$-7a | PO | 132 |
| 699815 | GalNAc$_3$-7$_{a-o'}$T$_{es}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_e$ | GalNAc$_3$-7a | PO | 132 |

The structure of GalNAc$_3$-3$_a$ was shown previously in Example 39, and the structure of GalNAc$_3$-7$_a$ was shown previously in Example 48.

Subscripts:
"e" indicates 2'-MOE modified nucleoside;
"d" indicates β-D-2'-deoxyribonucleoside;
"k" indicates 6'-(S)-CH$_3$ bicyclic nucleoside (cEt);
"s" indicates phosphorothioate internucleoside linkages (PS);
"o" indicates phosphodiester internucleoside linkages (PO).
Supersript "m" indicates 5-methylcytosines.

Treatment

Six to eight week old C57BL/6 mice (Jackson Laboratory, Bar Harbor, Me.) were injected subcutaneously once at the dosage shown below with an oligonucleotide listed in Table 100 or with saline. Each treatment group consisted of 4 animals. The mice were sacrificed 72 hours following the final administration. Liver SRB-1 mRNA levels were measured using real-time PCR. SRB-1 mRNA levels were normalized to cyclophilin mRNA levels according to standard protocols. The results are presented as the average percent of SRB-1 mRNA levels for each treatment group relative to the saline control group. As illustrated in Table 101, treatment with antisense oligonucleotides lowered SRB-1 mRNA levels in a dose-dependent manner, and the gapmer oligonucleotides comprising a GalNAc conjugate and having wings that were either full cEt or mixed sugar modifications were significantly more potent than the parent oligonucleotide lacking a conjugate and comprising full cEt modified wings.

Body weights, liver transaminases, total bilirubin, and BUN were also measured, and the average values for each treatment group are shown in Table 101. Body weight is shown as the average percent body weight relative to the baseline body weight (% BL) measured just prior to the oligonucleotide dose.

TABLE 101

SRB-1 mRNA, ALT, AST, BUN, and total bilirubin levels and body weights

| ISIS No. | Dosage (mg/kg) | SRB-1 mRNA (% PBS) | ALT (U/L) | AST (U/L) | Bil | BUN | Body weight (% BL) |
|---|---|---|---|---|---|---|---|
| PBS | n/a | 100 | 31 | 84 | 0.15 | 28 | 102 |
| 449093 | 1 | 111 | 18 | 48 | 0.17 | 31 | 104 |
| | 3 | 94 | 20 | 43 | 0.15 | 26 | 103 |
| | 10 | 36 | 19 | 50 | 0.12 | 29 | 104 |
| 699806 | 0.1 | 114 | 23 | 58 | 0.13 | 26 | 107 |
| | 0.3 | 59 | 21 | 45 | 0.12 | 27 | 108 |
| | 1 | 25 | 30 | 61 | 0.12 | 30 | 104 |

TABLE 101-continued

SRB-1 mRNA, ALT, AST, BUN, and total bilirubin levels and body weights

| ISIS No. | Dosage (mg/kg) | SRB-1 mRNA (% PBS) | ALT (U/L) | AST (U/L) | Bil | BUN | Body weight (% BL) |
|---|---|---|---|---|---|---|---|
| 699807 | 0.1 | 121 | 19 | 41 | 0.14 | 25 | 100 |
|  | 0.3 | 73 | 23 | 56 | 0.13 | 26 | 105 |
|  | 1 | 24 | 22 | 69 | 0.14 | 25 | 102 |
| 699809 | 0.1 | 125 | 23 | 57 | 0.14 | 26 | 104 |
|  | 0.3 | 70 | 20 | 49 | 0.10 | 25 | 105 |
|  | 1 | 33 | 34 | 62 | 0.17 | 25 | 107 |
| 699811 | 0.1 | 123 | 48 | 77 | 0.14 | 24 | 106 |
|  | 0.3 | 94 | 20 | 45 | 0.13 | 25 | 101 |
|  | 1 | 66 | 57 | 104 | 0.14 | 24 | 107 |
| 699813 | 0.1 | 95 | 20 | 58 | 0.13 | 28 | 104 |
|  | 0.3 | 98 | 22 | 61 | 0.17 | 28 | 105 |
|  | 1 | 49 | 19 | 47 | 0.11 | 27 | 106 |
| 699815 | 0.1 | 93 | 30 | 79 | 0.17 | 25 | 105 |
|  | 0.3 | 64 | 30 | 61 | 0.12 | 26 | 105 |
|  | 1 | 24 | 18 | 41 | 0.14 | 25 | 106 |

Example 94

Antisense Inhibition In Vivo by Oligonucleotides Targeting SRB-1 Comprising 2'-Sugar Modifications and a 5'-GalNAc$_3$ Conjugate The oligonucleotides listed in Table 102 were tested in a dose-dependent study for antisense inhibition of SRB-1 in mice.

TABLE 102

Modified ASOs targeting SRB-1

| ISIS No. | Sequences (5' to 3') | GalNAc$_3$ Cluster | CM | SEQ ID No. |
|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | n/a | n/a | 108 |
| 700989 | G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_m$ | n/a | n/a | 133 |
| 666904 | GalNAc$_3$-3$_{a-o'}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | PO | 108 |
| 700991 | GalNAc$_3$-7$_{a-o'}$G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_m$ | GalNAc$_3$-7a | PO | 133 |

Subscript "m" indicates a 2'-O-methyl modified nucleoside.

See Example 74 for complete table legend.

The structure of GalNAc$_3$-3$_a$ was shown previously in Example 39, and the structure of GalNAc$_3$-7$_a$ was shown previously in Example 48.

Treatment

The study was completed using the protocol described in Example 93. Results are shown in Table 103 below and show that both the 2'-MOE and 2'-OMe modified oligonucleotides comprising a GalNAc conjugate were significantly more potent than the respective parent oligonucleotides lacking a conjugate. The results of the body weights, liver transaminases, total bilirubin, and BUN measurements indicated that the compounds were all well tolerated.

TABLE 103

SRB-1 mRNA

| ISIS No. | Dosage (mg/kg) | SRB-1 mRNA (% PBS) |
|---|---|---|
| PBS | n/a | 100 |
| 353382 | 5 | 116 |
|  | 15 | 58 |
|  | 45 | 27 |
| 700989 | 5 | 120 |
|  | 15 | 92 |
|  | 45 | 46 |
| 666904 | 1 | 98 |
|  | 3 | 45 |
|  | 10 | 17 |
| 700991 | 1 | 118 |
|  | 3 | 63 |
|  | 10 | 14 |

Example 95

Antisense Inhibition In Vivo by Oligonucleotides Targeting SRB-1 Comprising Bicyclic Nucleosides and a 5'-GalNAc$_3$ Conjugate The oligonucleotides listed in Table 104 were tested in a dose-dependent study for antisense inhibition of SRB-1 in mice.

TABLE 104

Modified ASOs targeting SRB-1

| ISIS No. | Sequences (5' to 3') | GalNAc$_3$ Cluster | CM | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | n/a | 104 |
| 666905 | GalNAc$_3$-3$_{a-o'}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-3$_a$ | PO | 104 |
| 699782 | GalNAc$_3$-7$_{a-o'}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-7$_a$ | PO | 104 |
| 699783 | GalNAc$_3$-3$_{a-o'}$T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_l$ | GalNAc$_3$-3$_a$ | PO | 104 |
| 653621 | T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_{lo}$A$_{do'}$-GalNAc$_3$-1$_a$ | GalNAc$_3$-1$_a$ | A$_d$ | 112 |
| 439879 | T$_{gs}$$^m$C$_{gs}$A$_{ds}$G$_{ds}$T$_{ds}$$^m$C$_{ds}$A$_{ds}$T$_d$ G$_{ds}$A$_{ds}$$^m$C$_{ds}$T$_{ds}$T$_{gs}$$^m$C$_g$ | n/a | n/a | 104 |
| 699789 | GalNAc$_3$-3$_{a-o'}$T$_{gs}$$^m$C$_{gs}$A$_{ds}$G$_{ds}$T$_{ds}$$^m$C$_{ds}$A$_{ds}$T$_d$ G$_{ds}$A$_{ds}$$^m$C$_{ds}$T$_{ds}$T$_{gs}$$^m$C$_g$ | GalNAc$_3$-3$_a$ | PO | 104 |

Subscript "g" indicates a fluoro-HNA nucleoside, subscript "l" indicates a locked nucleoside comprising a 2'-O-CH$_2$-4' bridge.
See the Example 74 table legend for other abbreviations.
The structure of GalNAc3-1a was shown previously in Example 9, the structure of GalNAc$_3$-3$_a$ was shown previously in Example 39, and the structure of GalNAc$_3$-7$_a$ was shown previously in Example 48.

Treatment

The study was completed using the protocol described in Example 93. Results are shown in Table 105 below and show that oligonucleotides comprising a GalNAc conjugate and various bicyclic nucleoside modifications were significantly more potent than the parent oligonucleotide lacking a conjugate and comprising bicyclic nucleoside modifications. Furthermore, the oligonucleotide comprising a GalNAc conjugate and fluoro-HNA modifications was significantly more potent than the parent lacking a conjugate and comprising fluoro-HNA modifications. The results of the body weights, liver transaminases, total bilirubin, and BUN measurements indicated that the compounds were all well tolerated.

TABLE 105

SRB-1 mRNA, ALT, AST, BUN, and total bilirubin levels and body weights

| ISIS No. | Dosage (mg/kg) | SRB-1 mRNA (% PBS) |
|---|---|---|
| PBS | n/a | 100 |
| 440762 | 1 | 104 |
|  | 3 | 65 |
|  | 10 | 35 |
| 666905 | 0.1 | 105 |
|  | 0.3 | 56 |
|  | 1 | 18 |
| 699782 | 0.1 | 93 |
|  | 0.3 | 63 |
|  | 1 | 15 |
| 699783 | 0.1 | 105 |
|  | 0.3 | 53 |
|  | 1 | 12 |
| 653621 | 0.1 | 109 |
|  | 0.3 | 82 |
|  | 1 | 27 |
| 439879 | 1 | 96 |
|  | 3 | 77 |
|  | 10 | 37 |
| 699789 | 0.1 | 82 |
|  | 0.3 | 69 |
|  | 1 | 26 |

Example 96

Plasma Protein Binding of Antisense Oligonucleotides Comprising a GalNAc$_3$ Conjugate Group Oligonucleotides listed in Table 70 targeting ApoC-III and oligonucleotides in Table 106 targeting Apo(a) were tested in an ultra-filtration assay in order to assess plasma protein binding.

TABLE 106

Modified oligonucleotides targeting Apo(a)

| ISIS No. | Sequences (5' to 3') | GalNAc$_3$ Cluster | CM | SEQ ID No |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_e$ | n/a | n/a | 25 |
| 693401 | T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_e$ | n/a | n/a | 25 |
| 681251 | GalNAc$_3$-7$_{a-o'}$T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_e$ | GalNAc$_3$-7$_a$ | PO | 25 |

TABLE 106-continued

Modified oligonucleotides targeting Apo(a)

| ISIS No. | Sequences (5' to 3') | GalNAc$_3$ Cluster | CM | SEQ ID No |
|---|---|---|---|---|
| 681257 | GalNAc$_3$-7$_{a-o'}$T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$ T$_{ds}$G$_{ds}$$^m$C$_{ds}$T$_{ds}$T$_{eo}$G$_{eo}$T$_{es}$T$_{es}$$^m$C$_e$ | GalNAc$_3$-7$_a$ | PO | 25 |

See the Example 74 for table legend.
The structure of GalNAc$_3$-7a was shown previously in Example 48.

Ultrafree-MC ultrafiltration units (30,000 NMWL, low-binding regenerated cellulose membrane, Millipore, Bedford, Mass.) were pre-conditioned with 300 μL of 0.5% Tween 80 and centrifuged at 2000 g for 10 minutes, then with 300 μL of a 300 μg/mL solution of a control oligonucleotide in H$_2$O and centrifuged at 2000 g for 16 minutes. In order to assess non-specific binding to the filters of each test oligonucleotide from Tables 70 and 106 to be used in the studies, 300 μL of a 250 ng/mL solution of oligonucleotide in H$_2$O at pH 7.4 was placed in the pre-conditioned filters and centrifuged at 2000 g for 16 minutes. The unfiltered and filtered samples were analyzed by an ELISA assay to determine the oligonucleotide concentrations. Three replicates were used to obtain an average concentration for each sample. The average concentration of the filtered sample relative to the unfiltered sample is used to determine the percent of oligonucleotide that is recovered through the filter in the absence of plasma (% recovery).

Frozen whole plasma samples collected in K3-EDTA from normal, drug-free human volunteers, cynomolgus monkeys, and CD-1 mice, were purchased from Bioreclamation LLC (Westbury, N.Y.). The test oligonucleotides were added to 1.2 mL aliquots of plasma at two concentrations (5 and 150 μg/mL). An aliquot (300 μL) of each spiked plasma sample was placed in a pre-conditioned filter unit and incubated at 37° C. for 30 minutes, immediately followed by centrifugation at 2000 g for 16 minutes. Aliquots of filtered and unfiltered spiked plasma samples were analyzed by an ELISA to determine the oligonucleotide concentration in each sample. Three replicates per concentration were used to determine the average percentage of bound and unbound oligonucleotide in each sample. The average concentration of the filtered sample relative to the concentration of the unfiltered sample is used to determine the percent of oligonucleotide in the plasma that is not bound to plasma proteins (% unbound). The final unbound oligonucleotide values are corrected for non-specific binding by dividing the % unbound by the % recovery for each oligonucleotide. The final % bound oligonucleotide values are determined by subtracting the final % unbound values from 100. The results are shown in Table 107 for the two concentrations of oligonucleotide tested (5 and 150 μg/mL) in each species of plasma. The results show that GalNAc conjugate groups do not have a significant impact on plasma protein binding. Furthermore, oligonucleotides with full PS internucleoside linkages and mixed PO/PS linkages both bind plasma proteins, and those with full PS linkages bind plasma proteins to a somewhat greater extent than those with mixed PO/PS linkages.

TABLE 107

Percent of modified oligonucleotide bound to plasma proteins

| | Human plasma | | Monkey plasma | | Mouse plasma | |
|---|---|---|---|---|---|---|
| ISIS No. | 5 μg/mL | 150 μg/mL | 5 μg/mL | 150 μg/mL | 5 μg/mL | 150 μg/mL |
| 304801 | 99.2 | 98.0 | 99.8 | 99.5 | 98.1 | 97.2 |
| 663083 | 97.8 | 90.9 | 99.3 | 99.3 | 96.5 | 93.0 |
| 674450 | 96.2 | 97.0 | 98.6 | 94.4 | 94.6 | 89.3 |
| 494372 | 94.1 | 89.3 | 98.9 | 97.5 | 97.2 | 93.6 |
| 693401 | 93.6 | 89.9 | 96.7 | 92.0 | 94.6 | 90.2 |
| 681251 | 95.4 | 93.9 | 99.1 | 98.2 | 97.8 | 96.1 |
| 681257 | 93.4 | 90.5 | 97.6 | 93.7 | 95.6 | 92.7 |

Example 97

Modified Oligonucleotides Targeting TTR Comprising a GalNAc$_3$ Conjugate Group

The oligonucleotides shown in Table 108 comprising a GalNAc conjugate were designed to target TTR.

TABLE 108

Modified oligonucleotides targeting TTR

| ISIS No. | Sequences (5' to 3') | GalNAc$_3$ Cluster | CM | SEQ ID No |
|---|---|---|---|---|
| 666941 | GalNAc$_3$-3$_{a-o'}$A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-3 | A$_d$ | 128 |
| 666942 | T$_{es}$ $^m$C$_{eo}$ T$_{eo}$ T$_{eo}$ G$_{eo}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{eo}$ T$_{eo}$ $^m$C$_{es}$ $^m$C$_{es}$ $^m$C$_{eo}$ A$_{do'}$-GalNAc$_3$-3$_a$ | GalNAc$_3$-1 | A$_d$ | 125 |
| 682876 | GalNac$_3$-3$_{a-o'}$T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-3 | PO | 74 |
| 682877 | GalNAc$_3$-7$_{a-o'}$T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-7 | PO | 74 |
| 682878 | GalNac$_3$-10$_{a-o'}$T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-10 | PO | 74 |

TABLE 108-continued

Modified oligonucleotides targeting TTR

| ISIS No. | Sequences (5' to 3') | GalNAc$_3$ Cluster | CM | SEQ ID No |
|---|---|---|---|---|
| 682879 | GalNAc$_3$-13$_{a-o}$,T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-13 | PO | 74 |
| 682880 | GalNAc$_3$-7$_{a-o}$,A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-7 | A$_d$ | 128 |
| 682881 | GalNAc$_3$-10$_{a-o}$,A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-10 | A$_d$ | 128 |
| 682882 | GalNAc$_3$-13$_{a-o}$,A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_e$ | GalNAc$_3$-13 | A$_d$ | 128 |
| 684056 | T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{es}$ A$_{do}$,-GalNAc$_3$-19$_a$ | GalNAc$_3$-19 | A$_d$ | 125 |

The legend for Table 108 can be found in Example 74.
The structure of GalNAc$_3$-1 was shown in Example 9.
The structure of GalNAc$_3$-3$_a$ was shown in Example 39.
The structure of GalNAc$_3$-7$_a$ was shown in Example 48.
The structure of GalNAc$_3$-10$_a$ was shown in Example 46.
The structure of GalNAc$_3$-13$_a$ was shown in Example 62.
The structure of GalNAc$_3$-19$_a$ was shown in Example 70.

Example 98

Evaluation of Pro-Inflammatory Effects of Oligonucleotides Comprising a GalNAc Conjugate in hPMBC Assay The oligonucleotides listed in Table 109 and were tested for pro-inflammatory effects in an hPMBC assay as described in Examples 23 and 24. (See Tables 30, 83, 95, and 108 for descriptions of the oligonucleotides.) ISIS 353512 is a high responder used as a positive control, and the other oligonucleotides are described in Tables 83, 95, and 108. The results shown in Table 109 were obtained using blood from one volunteer donor. The results show that the oligonucleotides comprising mixed PO/PS internucleoside linkages produced significantly lower pro-inflammatory responses compared to the same oligonucleotides having full PS linkages. Furthermore, the GalNAc conjugate group did not have a significant effect in this assay.

TABLE 109

| ISIS No. | E$_{max}$/EC$_{50}$ | GalNAc$_3$ cluster | Linkages | CM |
|---|---|---|---|---|
| 353512 | 3630 | n/a | PS | n/a |
| 420915 | 802 | n/a | PS | n/a |
| 682881 | 1311 | GalNAc$_3$-10 | PS | A$_d$ |
| 682888 | 0.26 | GalNAc$_3$-10 | PO/PS | A$_d$ |
| 684057 | 1.03 | GalNAc$_3$-19 | PO/PS | A$_d$ |

Example 99

Binding Affinities of Oligonucleotides Comprising a GalNAc Conjugate for the Asialoglycoprotein Receptor The binding affinities of the oligonucleotides listed in Table 110 (see Table 76 for descriptions of the oligonucleotides) for the asialoglycoprotein receptor were tested in a competitive receptor binding assay. The competitor ligand, α1-acid glycoprotein (AGP), was incubated in 50 mM sodium acetate buffer (pH 5) with 1 U neuraminidase-agarose for 16 hours at 37° C., and >90% desialylation was confirmed by either sialic acid assay or size exclusion chromatography (SEC). Iodine monochloride was used to iodinate the AGP according to the procedure by Atsma et al. (see J Lipid Res. 1991 January; 32(1):173-81.) In this method, desialylated α1-acid glycoprotein (de-AGP) was added to 10 mM iodine chloride, Na$^{125}$I, and 1 M glycine in 0.25 M NaOH. After incubation for 10 minutes at room temperature, $^{125}$I-labeled de-AGP was separated from free $^{125}$I by concentrating the mixture twice utilizing a 3 KDMWCO spin column. The protein was tested for labeling efficiency and purity on a HPLC system equipped with an Agilent SEC-3 column (7.8× 300 mm) and a β-RAM counter. Competition experiments utilizing $^{125}$I-labeled de-AGP and various GalNAc-cluster containing ASOs were performed as follows. Human HepG2 cells (10$^6$ cells/ml) were plated on 6-well plates in 2 ml of appropriate growth media. MEM media supplemented with 10% fetal bovine serum (FBS), 2 mM L-Glutamine and 10 mM HEPES was used. Cells were incubated 16-20 hours @ 37° C. with 5% and 10% CO$_2$ respectively. Cells were washed with media without FBS prior to the experiment. Cells were incubated for 30 min @37° C. with 1 ml competition mix containing appropriate growth media with 2% FBS, 10$^{-8}$ M $^{125}$I-labeled de-AGP and GalNAc-cluster containing ASOs at concentrations ranging from 10$^{-11}$ to 10$^{-5}$ M. Non-specific binding was determined in the presence of 10$^{-2}$ M GalNAc sugar. Cells were washed twice with media without FBS to remove unbound $^{125}$I-labeled de-AGP and competitor GalNAc ASO. Cells were lysed using Qiagen's RLT buffer containing 1% β-mercaptoethanol. Lysates were transferred to round bottom assay tubes after a brief 10 min freeze/thaw cycle and assayed on a γ-counter. Non-specific binding was subtracted before dividing $^{125}$I protein counts by the value of the lowest GalNAc-ASO concentration counts. The inhibition curves were fitted according to a single site competition binding equation using a nonlinear regression algorithm to calculate the binding affinities (K$_D$'s).

The results in Table 110 were obtained from experiments performed on five different days. Results for oligonucleotides marked with superscript "a" are the average of experiments run on two different days. The results show that the oligonucleotides comprising a GalNAc conjugate group on the 5'-end bound the asialoglycoprotein receptor on human HepG2 cells with 1.5 to 16-fold greater affinity than the oligonucleotides comprising a GalNAc conjugate group on the 3'-end.

TABLE 110

Asialoglycoprotein receptor binding assay results

| ISIS No. | GalNAc conjugate | Oligonucleotide end to which GalNAc conjugate is attached | $K_D$ (nM) |
|---|---|---|---|
| 661161[a] | GalNAc$_3$-3 | 5' | 3.7 |
| 666881[a] | GalNAc$_3$-10 | 5' | 7.6 |
| 666981 | GalNAc$_3$-7 | 5' | 6.0 |
| 670061 | GalNAc$_3$-13 | 5' | 7.4 |
| 655861[a] | GalNAc$_3$-1 | 3' | 11.6 |
| 677841[a] | GalNAc$_3$-19 | 3' | 60.8 |

Example 100

Antisense Inhibition In Vivo by Oligonucleotides Comprising a GalNAc Conjugate Group Targeting Apo(a) In Vivo The oligonucleotides listed in Table 111a below were tested in a single dose study for duration of action in mice.

TABLE 111a

Modified ASOs targeting APO(a)

| ISIS No. | Sequences (5' to 3') | GalNAc$_3$ Cluster | CM | SEQ ID No. |
|---|---|---|---|---|
| 681251 | GalNAc$_3$-7$_{a-o'}$T$_{es}$G$_{es}$$^m$C$_{es}$T$_{es}$$^m$C$_{es}$$^m$C$_{ds}$G$_{ds}$T$_{ds}$T$_{ds}$G$_{ds}$ G$_{ds}$T$_{ds}$G$_{ds}$$^m$C$_{ds}$T$_{ds}$T$_{es}$G$_{es}$T$_{es}$T$_{es}$$^m$C$_e$ | GalNAc$_3$-7a | PO | 25 |
| 681257 | GalNAc$_3$-7$_{a-o'}$T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$ G$_{ds}$T$_{ds}$G$_{ds}$$^m$C$_{ds}$T$_{ds}$T$_{eo}$G$_{eo}$T$_{es}$T$_{es}$$^m$C$_e$ | GalNAc$_3$-7a | PO | 25 |

The structure of GalNAc$_3$-7$_a$ was shown in Example 48.

TABLE 111b

| | Apo(a) plasma protein levels | | | |
|---|---|---|---|---|
| ISIS No. | Dosage (mg/kg) | Apo(a) at 72 hours (% BL) | Apo(a) at 1 week (% BL) | Apo(a) at 3 weeks (% BL) |
| PBS | n/a | 116 | 104 | 107 |
| 681251 | 0.3 | 97 | 108 | 93 |
| | 1.0 | 85 | 77 | 57 |
| | 3.0 | 54 | 49 | 11 |
| | 10.0 | 23 | 15 | 4 |
| 681257 | 0.3 | 114 | 138 | 104 |
| | 1.0 | 91 | 98 | 54 |
| | 3.0 | 69 | 40 | 6 |
| | 10.0 | 30 | 21 | 4 |

Example 101

Antisense Inhibition by Oligonucleotides Comprising a GalNAC Cluster Linked Via a Stable Moiety The oligonucleotides listed in Table 112 were tested for inhibition of mouse APOC-III expression in vivo. C57Bl/6 mice were each injected subcutaneously once with an oligonucleotide listed in Table 112 or with PBS. Each treatment group consisted of 4 animals. Each mouse treated with ISIS Treatment Female transgenic mice that express human Apo(a) were each injected subcutaneously once per week, for a total of 6 doses, with an oligonucleotide and dosage listed in Table 111b or with PBS. Each treatment group consisted of 3 animals. Blood was drawn the day before dosing to determine baseline levels of Apo(a) protein in plasma and at 72 hours, 1 week, and 2 weeks following the first dose. Additional blood draws will occur at 3 weeks, 4 weeks, 5 weeks, and 6 weeks following the first dose. Plasma Apo(a) protein levels were measured using an ELISA. The results in Table 111b are presented as the average percent of plasma Apo(a) protein levels for each treatment group, normalized to baseline levels (% BL), The results show that the oligonucleotides comprising a GalNAc conjugate group exhibited potent reduction in Apo(a) expression. This potent effect was observed for the oligonucleotide that comprises full PS internucleoside linkages and the oligonucleotide that comprises mixed PO and PS linkages.

440670 received a dose of 2, 6, 20, or 60 mg/kg. Each mouse treated with ISIS 680772 or 696847 received 0.6, 2, 6, or 20 mg/kg. The GalNAc conjugate group of ISIS 696847 is linked via a stable moiety, a phosphorothioate linkage instead of a readily cleavable phosphodiester containing linkage. The animals were sacrificed 72 hours after the dose. Liver APOC-III mRNA levels were measured using real-time PCR. APOC-III mRNA levels were normalized to cyclophilin mRNA levels according to standard protocols. The results are presented in Table 112 as the average percent of APOC-III mRNA levels for each treatment group relative to the saline control group. The results show that the oligonucleotides comprising a GalNAc conjugate group were significantly more potent than the oligonucleotide lacking a conjugate group. Furthermore, the oligonucleotide comprising a GalNAc conjugate group linked to the oligonucleotide via a cleavable moiety (ISIS 680772) was even more potent than the oligonucleotide comprising a GalNAc conjugate group linked to the oligonucleotide via a stable moiety (ISIS 696847).

TABLE 112

Modified oligonucleotides targeting mouse APOC-III

| ISIS No. | Sequences (5' to 3') | CM | Dosage (mg/kg) | APOC-III mRNA (% PBS) | SEQ ID No. |
|---|---|---|---|---|---|
| 440670 | $^mC_{es}A_{es}G_{es}{}^mC_{es}T_{es}T_{ds}T_{ds}A_{ds}T_{ds}T_{ds}A_{ds}G_{ds}G_{ds}$ $G_{ds}A_{ds}{}^mC_{es}A_{es}G_{es}{}^mC_{es}A_e$ | n/a | 2<br>6<br>20<br>60 | 92<br>86<br>59<br>37 | 129 |
| 680772 | GalNAc$_3$-7$_{a-o}$,$^mC_{es}A_{es}G_{es}{}^mC_{es}T_{es}T_{ds}T_{ds}A_{ds}$ $T_{ds}T_{ds}A_{ds}G_{ds}G_{ds}G_{ds}A_{ds}{}^mC_{es}A_{es}G_{es}{}^mC_{es}A_e$ | PO | 0.6<br>2<br>6<br>20 | 79<br>58<br>31<br>13 | 129 |
| 696847 | GalNAc$_3$-7$_{a-o}$,$^mC_{es}A_{es}G_{es}{}^mC_{es}T_{es}T_{ds}T_{ds}A_{ds}$ $T_{ds}T_{ds}A_{ds}G_{ds}G_{ds}G_{ds}A_{ds}{}^mC_{es}A_{es}G_{es}{}^mC_{es}A_e$ | n/a (PS) | 0.6<br>2<br>6<br>20 | 83<br>73<br>40<br>28 | 129 |

The structure of GalNAc$_3$-7$_a$ was shown in Example 48.

Example 102

Distribution in Liver of Antisense Oligonucleotides Comprising a GalNAc Conjugate The liver distribution of ISIS 353382 (see Table 36) that does not comprise a GalNAc conjugate and ISIS 655861 (see Table 36) that does comprise a GalNAc conjugate was evaluated. Male balb/c mice were subcutaneously injected once with ISIS 353382 or 655861 at a dosage listed in Table 113. Each treatment group consisted of 3 animals except for the 18 mg/kg group for ISIS 655861, which consisted of 2 animals. The animals were sacrificed 48 hours following the dose to determine the liver distribution of the oligonucleotides. In order to measure the number of antisense oligonucleotide molecules per cell, a Ruthenium (II) tris-bipyridine tag (MSD TAG, Meso Scale Discovery) was conjugated to an oligonucleotide probe used to detect the antisense oligonucleotides. The results presented in Table 113 are the average concentrations of oligonucleotide for each treatment group in units of millions of oligonucleotide molecules per cell. The results show that at equivalent doses, the oligonucleotide comprising a GalNAc conjugate was present at higher concentrations in the total liver and in hepatocytes than the oligonucleotide that does not comprise a GalNAc conjugate. Furthermore, the oligonucleotide comprising a GalNAc conjugate was present at lower concentrations in non-parenchymal liver cells than the oligonucleotide that does not comprise a GalNAc conjugate. And while the concentrations of ISIS 655861 in hepatocytes and non-parenchymal liver cells were similar per cell, the liver is approximately 80% hepatocytes by volume. Thus, the majority of the ISIS 655861 oligonucleotide that was present in the liver was found in hepatocytes, whereas the majority of the ISIS 353382 oligonucleotide that was present in the liver was found in non-parenchymal liver cells.

TABLE 113

| ISIS No. | Dosage (mg/kg) | Concentration in whole liver (molecules*10^6 per cell) | Concentration in hepatocytes (molecules*10^6 per cell) | Concentration in non-parenchymal liver cells (molecules*10^6 per cell) |
|---|---|---|---|---|
| 353382 | 3 | 9.7 | 1.2 | 37.2 |
|  | 10 | 17.3 | 4.5 | 34.0 |
|  | 20 | 23.6 | 6.6 | 65.6 |
|  | 30 | 29.1 | 11.7 | 80.0 |
|  | 60 | 73.4 | 14.8 | 98.0 |
|  | 90 | 89.6 | 18.5 | 119.9 |
| 655861 | 0.5 | 2.6 | 2.9 | 3.2 |
|  | 1 | 6.2 | 7.0 | 8.8 |
|  | 3 | 19.1 | 25.1 | 28.5 |
|  | 6 | 44.1 | 48.7 | 55.0 |
|  | 18 | 76.6 | 82.3 | 77.1 |

Example 103

Duration of Action In Vivo of Oligonucleotides Targeting APOC-III Comprising a GalNAc$_3$ Conjugate The oligonucleotides listed in Table 114 below were tested in a single dose study for duration of action in mice.

TABLE 114

Modified ASOs targeting APOC-III

| ISIS No. | Sequences (5' to 3') | GalNAc$_3$ Cluster | CM | SEQ ID No. |
|---|---|---|---|---|
| 304801 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}$ $G_{ds}{}^mC_{ds}T_{es}T_{es}\ T_{es}A_{es}T_e$ | n/a | n/a | 32 |

TABLE 114-continued

Modified ASOs targeting APOC-III

| ISIS No. | Sequences (5' to 3') | GalNAc$_3$ Cluster | CM | SEQ ID No. |
|---|---|---|---|---|
| 663084 | GalNAc$_3$-3$_{a-o}$,A$_{do}$A$_{es}$G$_{eo}$$^m$C$_{eo}$T$_{eo}$T$_{eo}$$^m$C$_{ds}$T$_{ds}$T$_{ds}$ G$_{ds}$T$_{ds}$$^m$C$_{ds}$$^m$C$_{ds}$A$_{ds}$G$_{ds}$$^m$C$_{ds}$T$_{eo}$T$_{eo}$T$_{es}$A$_{es}$T$_e$ | GalNAc$_3$-3a | A$_d$ | 119 |
| 679241 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$ G$_{ds}$$^m$C$_{ds}$T$_{eo}$T$_{eo}$T$_{es}$A$_{es}$T$_{eo}$A$_{do}$,-GalNAc$_3$-19$_a$ | GalNAc$_3$-19a | A$_d$ | 111 |

The structure of GalNAc$_3$-3$_a$ was shown in Example 39, and GalNAc$_3$-19$_a$ was shown in Example 70.

Treatment

Female transgenic mice that express human APOC-III were each injected subcutaneously once with an oligonucleotide listed in Table 114 or with PBS. Each treatment group consisted of 3 animals. Blood was drawn before dosing to determine baseline and at 3, 7, 14, 21, 28, 35, and 42 days following the dose. Plasma triglyceride and APOC-III protein levels were measured as described in Example 20. The results in Table 115 are presented as the average percent of plasma triglyceride and APOC-III levels for each treatment group, normalized to baseline levels. A comparison of the results in Table 71 of example 79 with the results in Table 115 below show that oligonucleotides comprising a mixture of phosphodiester and phosphorothioate internucleoside linkages exhibited increased duration of action than equivalent oligonucleotides comprising only phosphorothioate internucleoside linkages.

TABLE 115

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| PBS | n/a | 3 | 96 | 101 | n/a | n/a |
|  |  | 7 | 88 | 98 |  |  |
|  |  | 14 | 91 | 103 |  |  |
|  |  | 21 | 69 | 92 |  |  |
|  |  | 28 | 83 | 81 |  |  |
|  |  | 35 | 65 | 86 |  |  |
|  |  | 42 | 72 | 88 |  |  |
| 304801 | 30 | 3 | 42 | 46 | n/a | n/a |
|  |  | 7 | 42 | 51 |  |  |
|  |  | 14 | 59 | 69 |  |  |
|  |  | 21 | 67 | 81 |  |  |
|  |  | 28 | 79 | 76 |  |  |
|  |  | 35 | 72 | 95 |  |  |
|  |  | 42 | 82 | 92 |  |  |
| 663084 | 10 | 3 | 35 | 28 | GalNAc$_3$-3a | A$_d$ |
|  |  | 7 | 23 | 24 |  |  |
|  |  | 14 | 23 | 26 |  |  |
|  |  | 21 | 23 | 29 |  |  |
|  |  | 28 | 30 | 22 |  |  |
|  |  | 35 | 32 | 36 |  |  |
|  |  | 42 | 37 | 47 |  |  |
| 679241 | 10 | 3 | 38 | 30 | GalNAc$_3$-19a | A$_d$ |
|  |  | 7 | 31 | 28 |  |  |
|  |  | 14 | 30 | 22 |  |  |
|  |  | 21 | 36 | 34 |  |  |
|  |  | 28 | 48 | 34 |  |  |
|  |  | 35 | 50 | 45 |  |  |
|  |  | 42 | 72 | 64 |  |  |

Example 104

Synthesis of Oligonucleotides Comprising a 5'-GalNAc$_2$ Conjugate

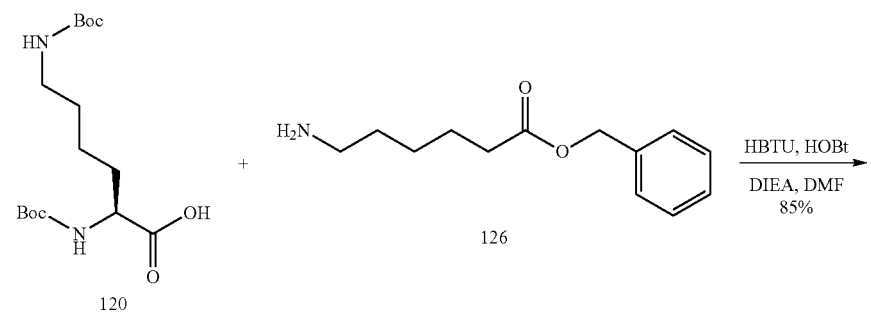

-continued
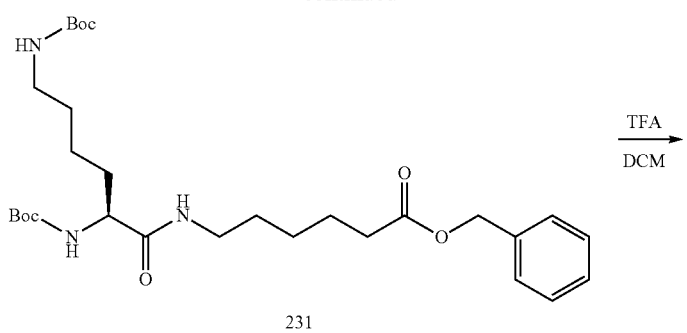
231
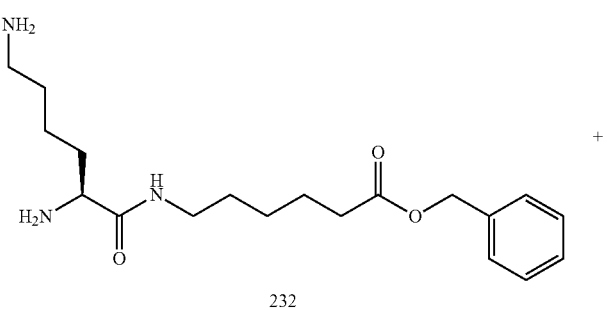
232
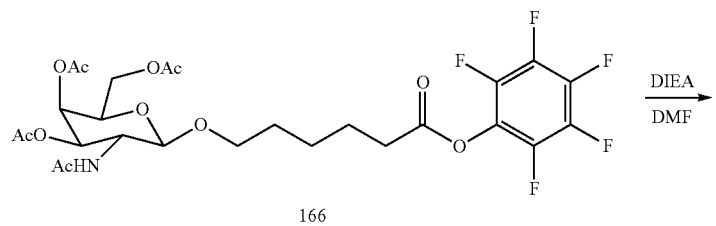
166
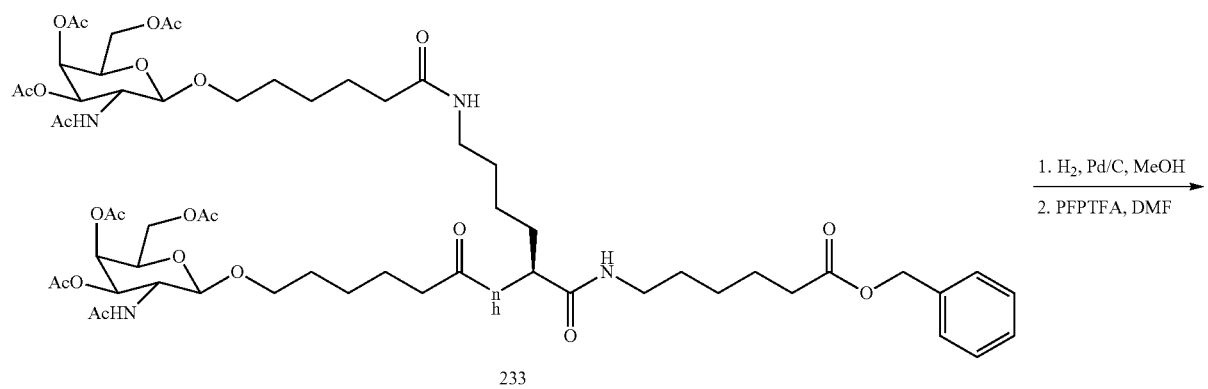
233
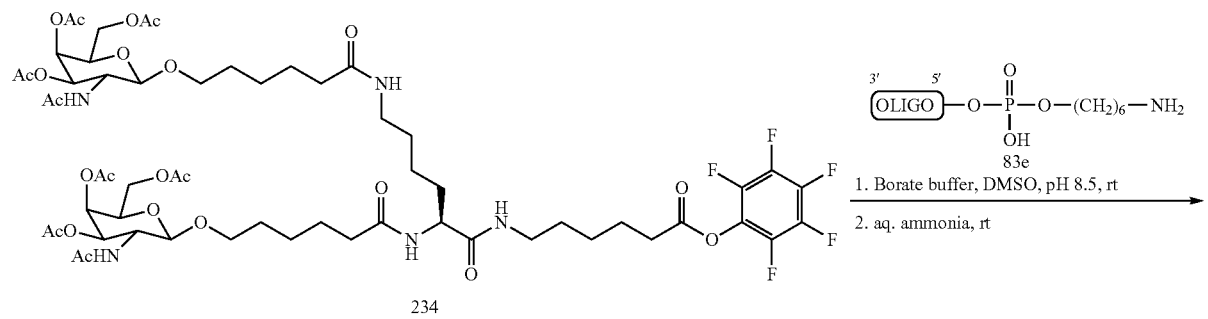
234

-continued

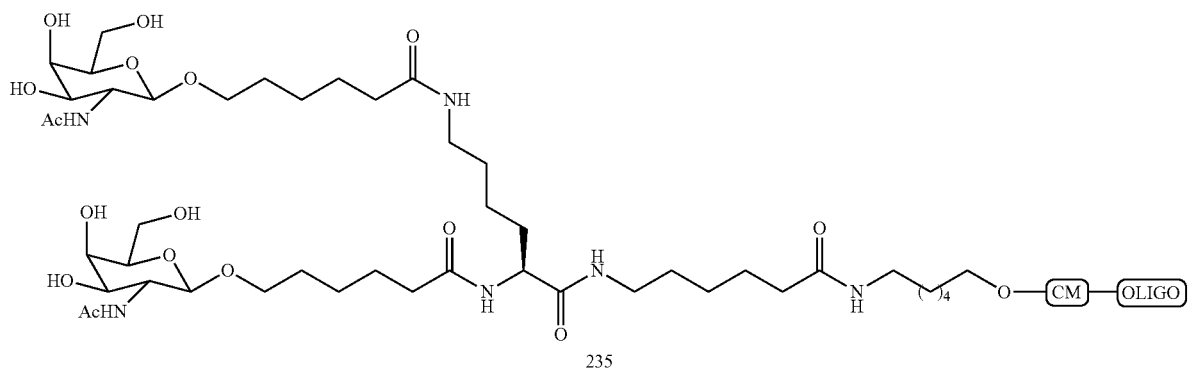

235

Compound 120 is commercially available, and the synthesis of compound 126 is described in Example 49. Compound 120 (1 g, 2.89 mmol), HBTU (0.39 g, 2.89 mmol), and HOBt (1.64 g, 4.33 mmol) were dissolved in DMF (10 mL. and N,N-diisopropylethylamine (1.75 mL, 10.1 mmol) were added. After about 5 min, aminohexanoic acid benzyl ester (1.36 g, 3.46 mmol) was added to the reaction. After 3 h, the reaction mixture was poured into 100 mL of 1 M NaHSO4 and extracted with 2×50 mL ethyl acetate. Organic layers were combined and washed with 3×40 mL sat NaHCO$_3$ and 2× brine, dried with Na$_2$SO$_4$, filtered and concentrated. The product was purified by silica gel column chromatography (DCM:EA:Hex, 1:1:1) to yield compound 231. LCMS and NMR were consistent with the structure. Compounds 231 (1.34 g, 2.438 mmol) was dissolved in dichloromethane (10 mL) and trifluoracetic acid (10 mL) was added. After stirring at room temperature for 2 h, the reaction mixture was concentrated under reduced pressure and co-evaporated with toluene (3×10 mL). The residue was dried under reduced pressure to yield compound 232 as the trifluoracetate salt. The synthesis of compound 166 is described in Example 54. Compound 166 (3.39 g, 5.40 mmol) was dissolved in DMF (3 mL). A solution of compound 232 (1.3 g, 2.25 mmol) was dissolved in DMF (3 mL) and N,N-diisopropylethylamine (1.55 mL) was added. The reaction was stirred at room temperature for 30 minutes, then poured into water (80 mL) and the aqueous layer was extracted with EtOAc (2×100 mL). The organic phase was separated and washed with sat. aqueous NaHCO$_3$ (3×80 mL), 1 M NaHSO$_4$ (3×80 mL) and brine (2×80 mL), then dried (Na$_2$SO$_4$), filtered, and concentrated. The residue was purified by silica gel column chromatography to yield compound 233. LCMS and NMR were consistent with the structure. Compound 233 (0.59 g, 0.48 mmol) was dissolved in methanol (2.2 mL) and ethyl acetate (2.2 mL). Palladium on carbon (10 wt % Pd/C, wet, 0.07 g) was added, and the reaction mixture was stirred under hydrogen atmosphere for 3 h. The reaction mixture was filtered through a pad of Celite and concentrated to yield the carboxylic acid. The carboxylic acid (1.32 g, 1.15 mmol, cluster free acid) was dissolved in DMF (3.2 mL). To this N,N-diisopropylethylamine (0.3 mL, 1.73 mmol) and PFPTFA (0.30 mL, 1.73 mmol) were added. After 30 min stirring at room temperature the reaction mixture was poured into water (40 mL) and extracted with EtOAc (2×50 mL). A standard work-up was completed as described above to yield compound 234. LCMS and NMR were consistent with the structure. Oligonucleotide 235 was prepared using the general procedure described in Example 46. The GalNAc$_2$ cluster portion (GalNAc$_2$-24$_a$ of the conjugate group GalNAc$_2$-24 can be combined with any cleavable moiety present on the oligonucleotide to provide a variety of conjugate groups. The structure of GalNAc$_2$-24 (GalNAc$_2$-24$_a$-CM) is shown below:

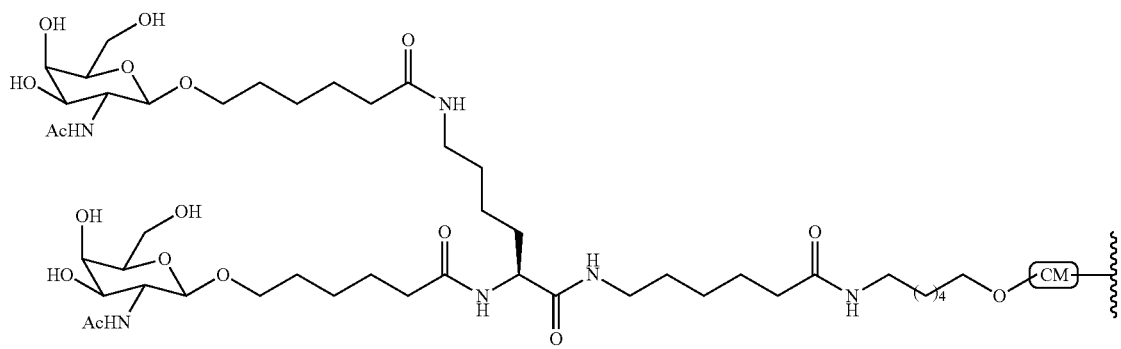

Example 105

Synthesis of Oligonucleotides Comprising a GalNAc$_1$-25 Conjugate

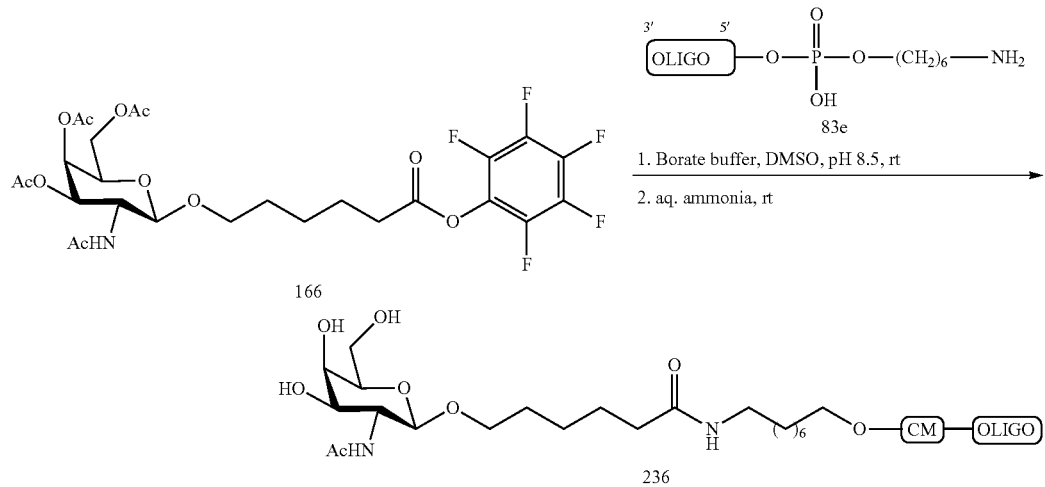

The synthesis of compound 166 is described in Example 54. Oligonucleotide 236 was prepared using the general procedure described in Example 46.

Alternatively, oligonucleotide 236 was synthesized using the scheme shown below, and compound 238 was used to form the oligonucleotide 236 using procedures described in Example 10.

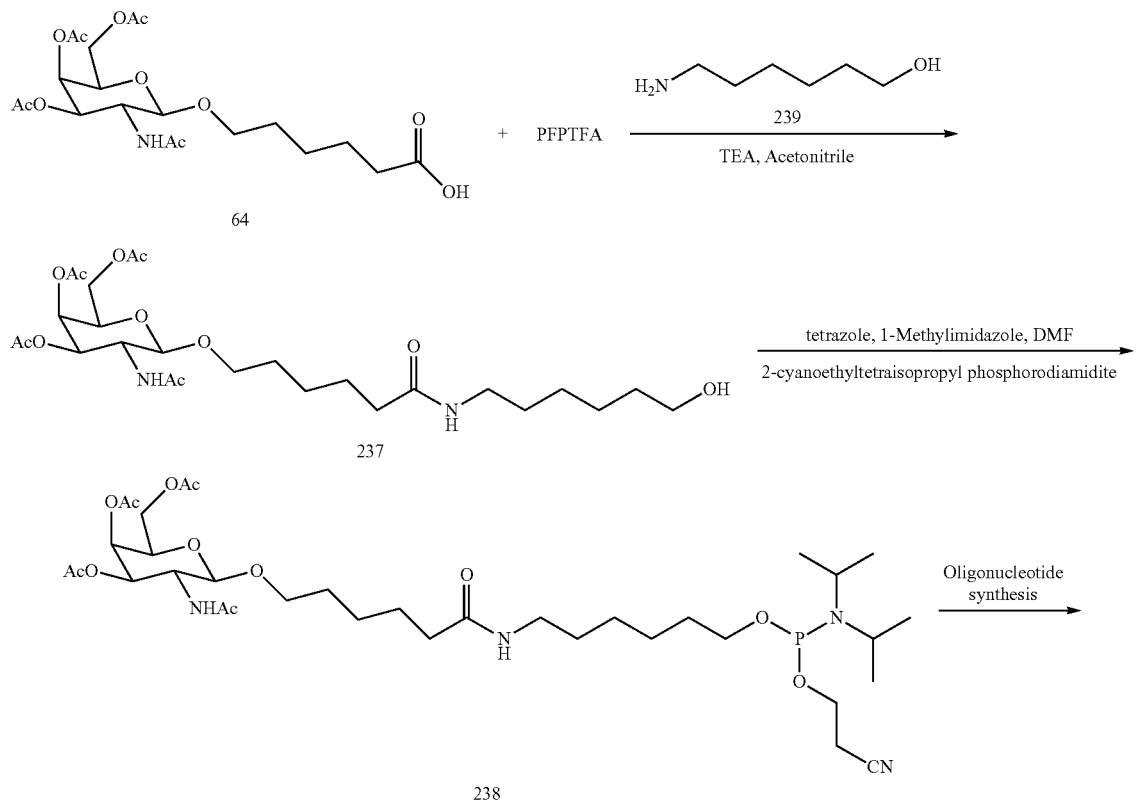

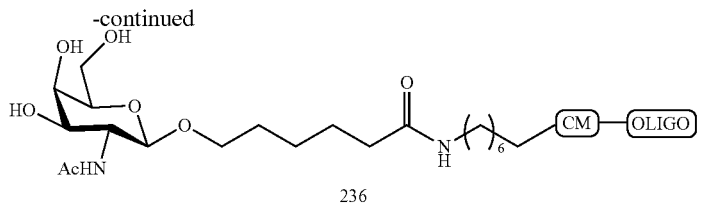

236

The GalNAc$_1$ cluster portion (GalNAc$_1$-25$_a$) of the conjugate group GalNAc$_1$-25 can be combined with any cleavable moiety present on the oligonucleotide to provide a variety of conjugate groups. The structure of GalNAc$_1$-25 (GalNAc$_1$-25$_a$-CM) is shown below:

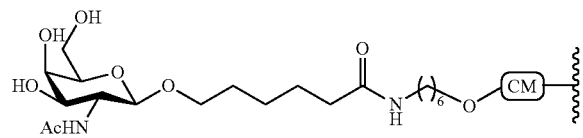

Example 106

Antisense Inhibition In Vivo by Oligonucleotides Targeting SRB-1 Comprising a 5'-GalNAc$_2$ or a 5'-GalNAc$_3$ Conjugate Oligonucleotides listed in Tables 116 and 117 were tested in dose-dependent studies for antisense inhibition of SRB-1 in mice.

Treatment

Six to week old, male C57BL/6 mice (Jackson Laboratory, Bar Harbor, Me.) were injected subcutaneously once with 2, 7, or 20 mg/kg of ISIS No. 440762; or with 0.2, 0.6, 2, 6, or 20 mg/kg of ISIS No. 686221, 686222, or 708561; or with saline. Each treatment group consisted of 4 animals. The mice were sacrificed 72 hours following the final administration. Liver SRB-1 mRNA levels were measured using real-time PCR. SRB-1 mRNA levels were normalized to cyclophilin mRNA levels according to standard protocols. The antisense oligonucleotides lowered SRB-1 mRNA levels in a dose-dependent manner, and the ED$_{50}$ results are presented in Tables 116 and 117. Although previous studies showed that trivalent GalNAc-conjugated oligonucleotides were significantly more potent than divalent GalNAc-conjugated oligonucleotides, which were in turn significantly more potent than monovalent GalNAc conjugated oligonucleotides (see, e.g., Khorev et al., *Bioorg. & Med. Chem.*, Vol. 16, 5216-5231 (2008)), treatment with antisense oligonucleotides comprising monovalent, divalent, and trivalent GalNAc clusters lowered SRB-1 mRNA levels with similar potencies as shown in Tables 116 and 117.

TABLE 116

Modified oligonucleotides targeting SRB-1

| ISIS No. | Sequences (5' to 3') | GalNAc Cluster | ED$_{50}$ (mg/kg) | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | 4.7 | 104 |
| 686221 | GalNAc$_2$-24$_{a-o}$,A$_{do}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_2$-24$_a$ | 0.39 | 114 |
| 686222 | GalNAc$_3$-13$_{a-o}$,A$_{do}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-13$_a$ | 0.41 | 114 |

See Example 93 for table legend.
The structure of GalNAc$_3$-13a was shown in Example 62, and the structure of GalNAc$_2$-24a was shown in Example 104.

TABLE 117

Modified oligonucleotides targeting SRB-1

| ISIS No. | Sequences (5' to 3') | GalNAc Cluster | ED$_{50}$ (mg/kg) | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | 5 | 104 |
| 708561 | GalNAc$_1$-25$_{a-o}$,T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_1$-25$_a$ | 0.4 | 104 |

See Example 93 for table legend.
The structure of GalNAc$_1$-25a was shown in Example 105.

The concentrations of the oligonucleotides in Tables 116 and 117 in liver were also assessed, using procedures described in Example 75. The results shown in Tables 117a and 117b below are the average total antisense oligonucleotide tissues levels for each treatment group, as measured by UV in units of μg oligonucleotide per gram of liver tissue. The results show that the oligonucleotides comprising a GalNAc conjugate group accumulated in the liver at significantly higher levels than the same dose of the oligonucleotide lacking a GalNAc conjugate group. Furthermore, the antisense oligonucleotides comprising one, two, or three GalNAc ligands in their respective conjugate groups all accumulated in the liver at similar levels. This result is surprising in view of the Khorev et al. literature reference cited above and is consistent with the activity data shown in Tables 116 and 117 above.

TABLE 117a

Liver concentrations of oligonucleotides comprising a GalNAc$_2$ or GalNAc$_3$ conjugate group

| ISIS No. | Dosage (mg/kg) | [Antisense oligonucleotide] (μg/g) | GalNAc cluster | CM |
|---|---|---|---|---|
| 440762 | 2 | 2.1 | n/a | n/a |
|  | 7 | 13.1 |  |  |
|  | 20 | 31.1 |  |  |
| 686221 | 0.2 | 0.9 | GalNAc$_2$-24$_a$ | A$_d$ |
|  | 0.6 | 2.7 |  |  |
|  | 2 | 12.0 |  |  |
|  | 6 | 26.5 |  |  |
| 686222 | 0.2 | 0.5 | GalNAc$_3$-13$_a$ | A$_d$ |
|  | 0.6 | 1.6 |  |  |
|  | 2 | 11.6 |  |  |
|  | 6 | 19.8 |  |  |

TABLE 117b

Liver concentrations of oligonucleotides comprising a GalNAc$_1$ conjugate group

| ISIS No. | Dosage (mg/kg) | [Antisense oligonucleotide] (μg/g) | GalNAc cluster | CM |
|---|---|---|---|---|
| 440762 | 2 | 2.3 | n/a | n/a |
|  | 7 | 8.9 |  |  |
|  | 20 | 23.7 |  |  |
| 708561 | 0.2 | 0.4 | GalNAc$_1$25$_a$ | PO |
|  | 0.6 | 1.1 |  |  |
|  | 2 | 5.9 |  |  |
|  | 6 | 23.7 |  |  |
|  | 20 | 53.9 |  |  |

Example 107

Synthesis of Oligonucleotides Comprising a GalNAc$_1$-26 or GalNAc$_1$-27 Conjugate

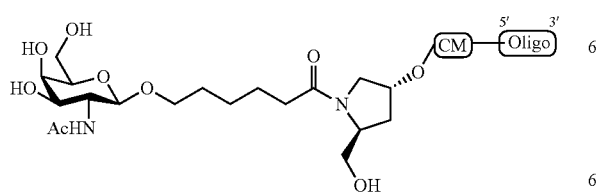

239

Oligonucleotide 239 is synthesized via coupling of compound 47 (see Example 15) to acid 64 (see Example 32) using HBTU and DIEA in DMF. The resulting amide containing compound is phosphitylated, then added to the 5'-end of an oligonucleotide using procedures described in Example 10. The GalNAc$_1$ cluster portion (GalNAc$_1$-26$_a$) of the conjugate group GalNAc$_1$-26 can be combined with any cleavable moiety present on the oligonucleotide to provide a variety of conjugate groups. The structure of GalNAc$_1$-26 (GalNAc$_1$-26$_a$-CM) is shown below:

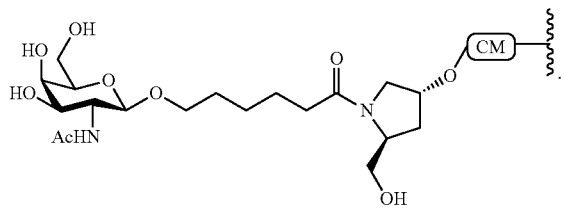

In order to add the GalNAc$_1$ conjugate group to the 3'-end of an oligonucleotide, the amide formed from the reaction of compounds 47 and 64 is added to a solid support using procedures described in Example 7. The oligonucleotide synthesis is then completed using procedures described in Example 9 in order to form oligonucleotide 240.

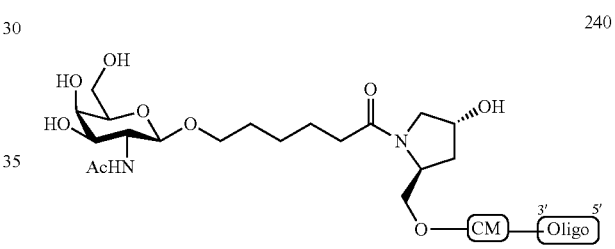

240

The GalNAc$_1$ cluster portion (GalNAc$_1$-27$_a$) of the conjugate group GalNAc$_1$-27 can be combined with any cleavable moiety present on the oligonucleotide to provide a variety of conjugate groups. The structure of GalNAc$_1$-27 (GalNAc$_1$-27$_a$-CM) is shown below:

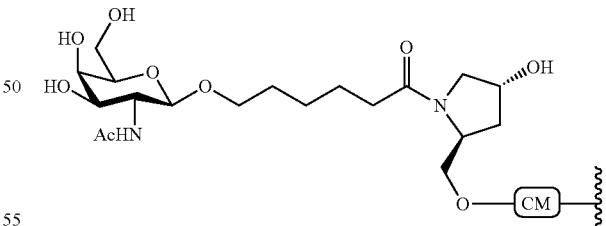

Example 108

Antisense Inhibition In Vivo by Oligonucleotides Comprising a GalNAc Conjugate Group Targeting Apo(a) In Vivo The oligonucleotides listed in Table 118 below were tested in a single dose study in mice.

TABLE 118

Modified ASOs targeting APO(a)

| ISIS No. | Sequences (5' to 3') | GalNAc$_3$ Cluster | CM | SEQ ID No. |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_{e}$ | n/a | n/a | 25 |
| 681251 | GalNAc$_3$-7$_{a-o}$,T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_{e}$ | GalNAc$_3$-7a | PO | 25 |
| 681255 | GalNAc$_3$-3$_{a-o}$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-3a | PO | 25 |
| 681256 | GalNAc$_3$-10$_{a-o}$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-10a | PO | 25 |
| 681257 | GalNAc$_3$-7$_{a-o}$,T$_{es}$G$_{eom}$C$_{eo}$T$_{eom}$C$_{eom}$C$_{ds}$G$_{ds}$T$_{ds}$T$_{ds}$G$_{ds}$G$_{ds}$T$_{ds}$G$_{dsm}$C$_{ds}$T$_{ds}$T$_{eo}$G$_{eo}$T$_{es}$T$_{esm}$C$_{e}$ | GalNAc$_3$-7a | PO | 25 |
| 681258 | GalNAc$_3$-13$_{a-o}$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-13a | PO | 25 |
| 681260 | T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$A$_{do}$,-GalNAc$_3$-19 | GalNAc$_3$-19a | A$_d$ | 134 |

The structure of GalNAc$_3$-7$_a$ was shown in Example 48.

Treatment

Male transgenic mice that express human Apo(a) were each injected subcutaneously once with an oligonucleotide and dosage listed in Table 119 or with PBS. Each treatment group consisted of 4 animals. Blood was drawn the day before dosing to determine baseline levels of Apo(a) protein in plasma and at 1 week following the first dose. Additional blood draws will occur weekly for approximately 8 weeks. Plasma Apo(a) protein levels were measured using an ELISA. The results in Table 119 are presented as the average percent of plasma Apo(a) protein levels for each treatment group, normalized to baseline levels (% BL), The results show that the antisense oligonucleotides reduced Apo(a) protein expression. Furthermore, the oligonucleotides comprising a GalNAc conjugate group exhibited even more potent reduction in Apo(a) expression than the oligonucleotide that does not comprise a conjugate group.

TABLE 119

Apo(a) plasma protein levels

| ISIS No. | Dosage (mg/kg) | Apo(a) at 1 week (% BL) |
|---|---|---|
| PBS | n/a | 143 |
| 494372 | 50 | 58 |
| 681251 | 10 | 15 |
| 681255 | 10 | 14 |
| 681256 | 10 | 17 |
| 681257 | 10 | 24 |
| 681258 | 10 | 22 |
| 681260 | 10 | 26 |

Example 109

Synthesis of Oligonucleotides Comprising a GalNAc$_1$-28 or GalNAc$_1$-29 Conjugate

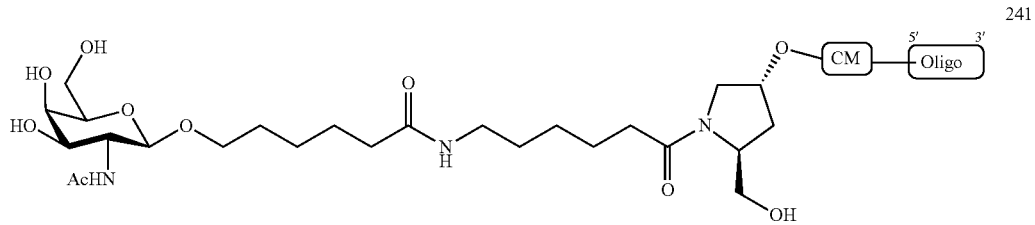

241

Oligonucleotide 241 is synthesized using procedures similar to those described in Example 71 to form the phosphoramidite intermediate, followed by procedures described in Example 10 to synthesize the oligonucleotide. The GalNAc$_1$ cluster portion (GalNAc$_1$-28$_a$) of the conjugate group GalNAc$_1$-28 can be combined with any cleavable moiety present on the oligonucleotide to provide a variety of conjugate groups. The structure of GalNAc$_1$-28 (GalNAc$_1$-28$_a$-CM) is shown below:

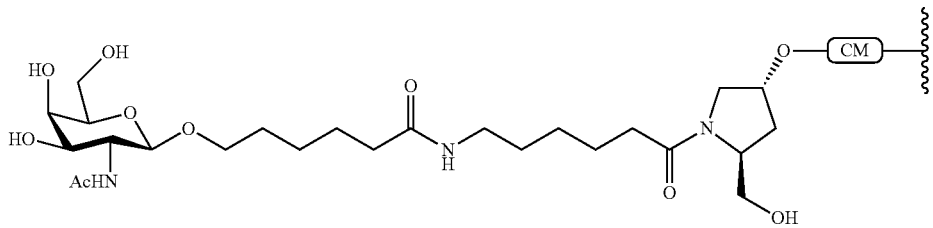

In order to add the GalNAc$_1$ conjugate group to the 3'-end of an oligonucleotide, procedures similar to those described in Example 71 are used to form the hydroxyl intermediate, which is then added to the solid support using procedures described in Example 7. The oligonucleotide synthesis is then completed using procedures described in Example 9 in order to form oligonucleotide 242.

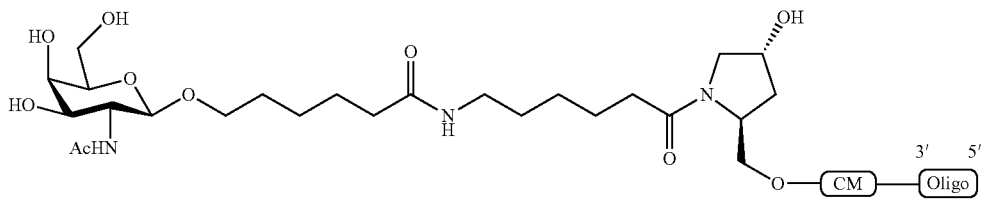

The GalNAc$_1$ cluster portion (GalNAc$_1$-29$_a$) of the conjugate group GalNAc$_1$-29 can be combined with any cleavable moiety present on the oligonucleotide to provide a variety of conjugate groups. The structure of GalNAc$_1$-29 (GalNAc$_1$-29$_a$-CM) is shown below:

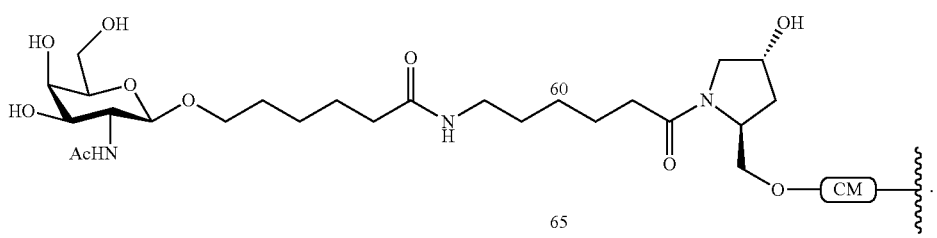

Example 110

Synthesis of Oligonucleotides Comprising a GalNAc$_1$-30 Conjugate

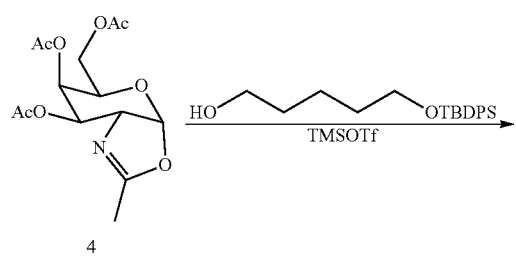

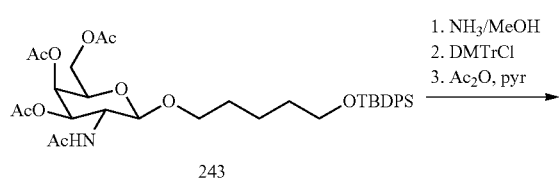

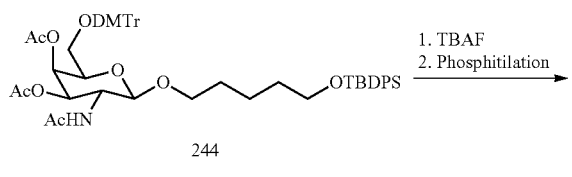

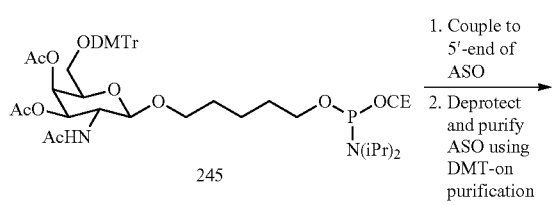

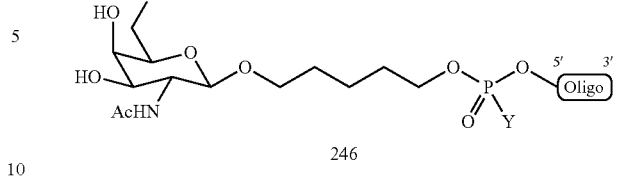

Oligonucleotide 246 comprising a GalNAc$_1$-30 conjugate group, wherein Y is selected from O, S, a substituted or unsubstituted $C_1$-$C_{10}$ alkyl, amino, substituted amino, azido, alkenyl or alkynyl, is synthesized as shown above. The GalNAc$_1$ cluster portion (GalNAc$_1$-30$_a$) of the conjugate group GalNAc$_1$-30 can be combined with any cleavable moiety to provide a variety of conjugate groups. In certain embodiments, Y is part of the cleavable moiety. In certain embodiments, Y is part of a stable moiety, and the cleavable moiety is present on the oligonucleotide. The structure of GalNAc$_1$-30$_a$ is shown below:

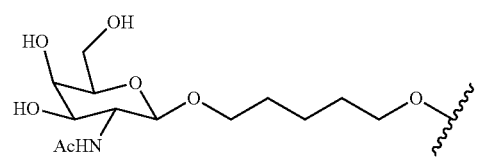 [SMILES: *OCCCCCOC1OC(CO)C(O)C(O)C1NC(C)=O]

Example 111

Synthesis of Oligonucleotides Comprising a GalNAc$_2$-31 or GalNAc$_2$-32 Conjugate

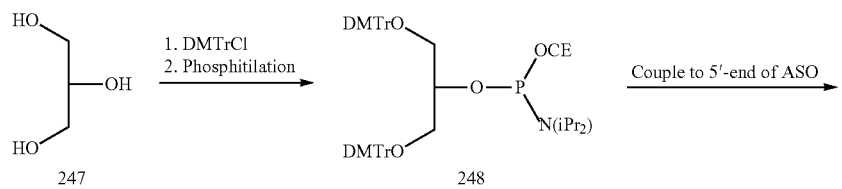

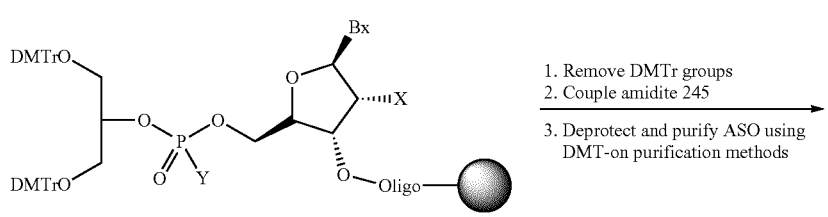

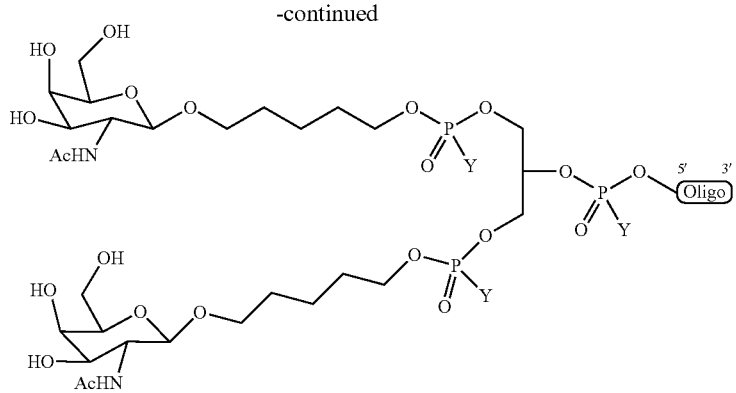

250

Oligonucleotide 250 comprising a GalNAc$_2$-31 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_2$ cluster portion (GalNAc$_2$-31$_a$) of the conjugate group GalNAc$_2$-31 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-31$_a$ is shown below:

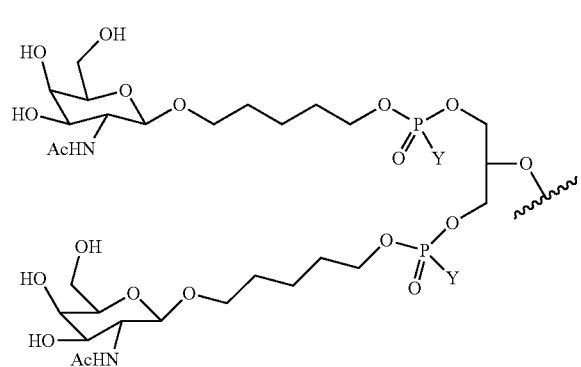

The synthesis of an oligonucleotide comprising a GalNAc$_2$-32 conjugate is shown below.

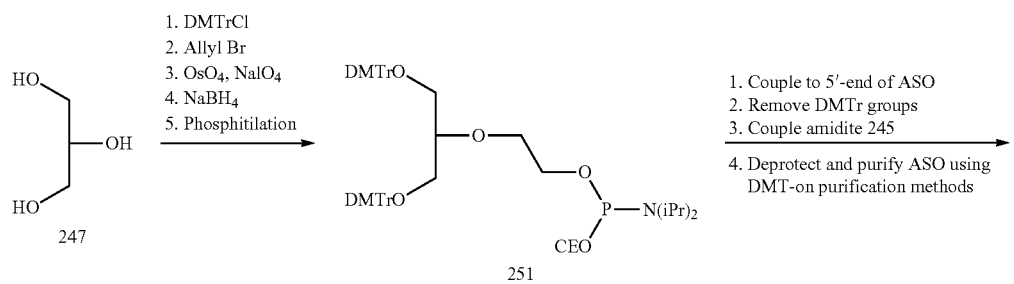

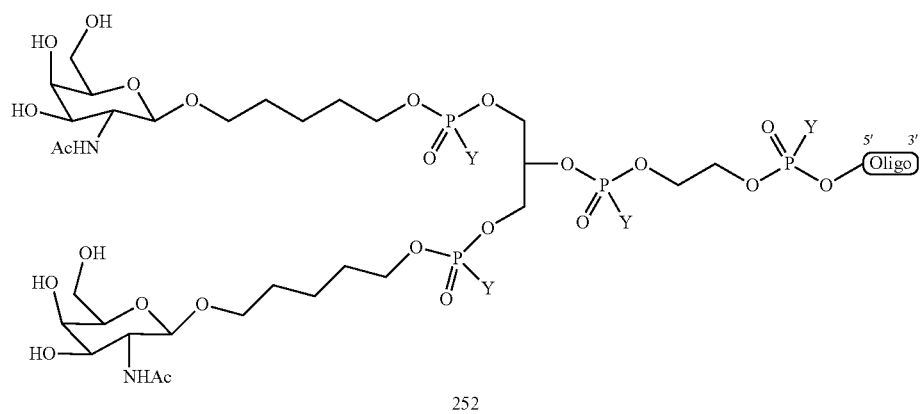

252

Oligonucleotide 252 comprising a GalNAc$_2$-32 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_2$ cluster portion (GalNAc$_2$-32$_a$) of the conjugate group GalNAc$_2$-32 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-32$_a$ is shown below:

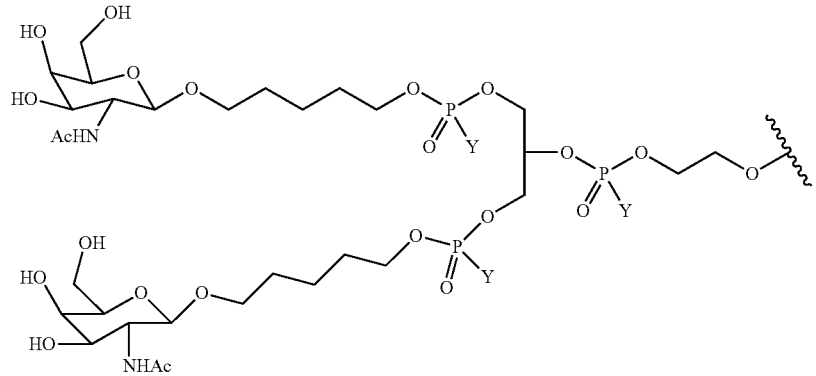

Example 112

Modified Oligonucleotides Comprising a GalNAc$_1$ Conjugate

The oligonucleotides in Table 120 targeting SRB-1 were synthesized with a GalNAc$_1$ conjugate group in order to further test the potency of oligonucleotides comprising conjugate groups that contain one GalNAc ligand.

TABLE 120

| ISIS No. | Sequence (5' to 3') | GalNAc cluster | CM | SEQ ID NO. |
|---|---|---|---|---|
| 711461 | GalNAc$_1$-25$_{a-o}$,A$_{do}$ G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-25$_a$ | A$_d$ | 109 |
| 711462 | GalNAc$_1$-25$_{a-o}$,G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-25$_a$ | PO | 108 |
| 711463 | GalNAc$_1$-25$_{a-o}$,G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_e$ | GalNAc$_1$-25$_a$ | PO | 108 |
| 711465 | GalNAc$_1$-26$_{a-o}$,A$_{do}$ G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-26$_a$ | A$_d$ | 109 |
| 711466 | GalNAc$_1$-26$_{a-o}$,G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-26$_a$ | PO | 108 |
| 711467 | GalNAc$_1$-26$_{a-o}$,G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_e$ | GalNAc$_1$-26$_a$ | PO | 108 |
| 711468 | GalNAc$_1$-28$_{a-o}$,A$_{do}$ G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-28$_a$ | A$_d$ | 109 |
| 711469 | GalNAc$_1$-28$_{a-o}$,G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-28$_a$ | PO | 108 |
| 711470 | GalNAc$_1$-28$_{a-o}$,G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_e$ | GalNAc$_1$-28$_a$ | PO | 108 |
| 713844 | G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_{eo'}$_GalNAc$_1$-27$_a$ | GalNAc$_1$-27$_a$ | PO | 108 |
| 713845 | G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_{eo'}$_GalNAc$_1$-27$_a$ | GalNAc$_1$-27$_a$ | PO | 108 |

TABLE 120-continued

| ISIS No. | Sequence (5' to 3') | GalNAc cluster | CM | SEQ ID NO. |
|---|---|---|---|---|
| 713846 | $G_{es}$ $^mC_{eo}$ $T_{eo}$ $T_{eo}$ $^mC_{eo}$ $A_{ds}$ $G_{ds}$ $T_{ds}$ $^mC_{ds}$ $A_{ds}$ $T_{ds}$ $G_{ds}$ $A_{ds}$ $^mC_{ds}$ $T_{ds}$ $T_{eo}$ $^mC_{eo}$ $^mC_{es}$ $T_{es}$ $T_{eo}$ $A_{do'}$-GalNAc$_1$-27$_a$ | GalNAc$_1$-27$_a$ | $A_d$ | 110 |
| 713847 | $G_{es}$ $^mC_{es}$ $T_{es}$ $T_{es}$ $^mC_{es}$ $A_{ds}$ $G_{ds}$ $T_{ds}$ $^mC_{ds}$ $A_{ds}$ $T_{ds}$ $G_{ds}$ $A_{ds}$ $^mC_{ds}$ $T_{ds}$ $T_{es}$ $^mC_{es}$ $^mC_{es}$ $T_{es}$ $T_{eo'}$-GalNAc$_1$-29$_a$ | GalNAc$_1$-29$_a$ | PO | 108 |
| 713848 | $G_{es}$ $^mC_{eo}$ $T_{eo}$ $T_{eo}$ $^mC_{eo}$ $A_{ds}$ $G_{ds}$ $T_{ds}$ $^mC_{ds}$ $A_{ds}$ $T_{ds}$ $G_{ds}$ $A_{ds}$ $^mC_{ds}$ $T_{ds}$ $T_{eo}$ $^mC_{eo}$ $^mC_{es}$ $T_{es}$ $T_{eo'}$-GalNAc$_1$-29$_a$ | GalNAc$_1$-29$_a$ | PO | 108 |
| 713849 | $G_{es}$ $^mC_{es}$ $T_{es}$ $T_{es}$ $^mC_{es}$ $A_{ds}$ $G_{ds}$ $T_{ds}$ $^mC_{ds}$ $A_{ds}$ $T_{ds}$ $G_{ds}$ $A_{ds}$ $^mC_{ds}$ $T_{ds}$ $T_{es}$ $^mC_{es}$ $^mC_{es}$ $T_{es}$ $T_{eo}$ $A_{do'}$-GalNAc$_1$-29$_a$ | GalNAc$_1$-29$_a$ | $A_d$ | 110 |
| 713850 | $G_{es}$ $^mC_{eo}$ $T_{eo}$ $T_{eo}$ $^mC_{eo}$ $A_{ds}$ $G_{ds}$ $T_{ds}$ $^mC_{ds}$ $A_{ds}$ $T_{ds}$ $G_{ds}$ $A_{ds}$ $^mC_{ds}$ $T_{ds}$ $T_{eo}$ $^mC_{eo}$ $^mC_{es}$ $T_{es}$ $T_{eo}$ $A_{do'}$-GalNAc$_1$-29$_a$ | GalNAc$_1$-29$_a$ | $A_d$ | 110 |

SEQUENCE LISTING (160 sequences)

SEQ ID NO: 1 - DNA, 191001 bp, Homo sapiens
ctgacagaaagcagatcattggttgcctgaggaggaggagtataggagaggtggagggaaaatgtacaaagtggcacaataaaaacttttggaatcatagatatattcactatcttgattgagtgatgatttcatgagtgcacgcgtgtgtcaaaaatgatcaatttatgcaactttaaatatgtgcagtttattgtatatatcaattatacctcagtacggctattaaaaagaaaccctctggctgcacaatgcagaactgattctaggaaagagtggagggaggatgaccatttacagtgctccaggtggaagagaacggtgccttctggaagtgaactaggttggcaacaacagagatgaaataaatgggcagatgtgtgagatacttaggaaataaaacccgatggtcaccattttccaaaggtcagctcatcctggctttccagagcaaagagctagggaagactttattaataaatccctcttgaagttgcagaggaagcttatagcagaaacttactctcaacctgactaatctgagagaacacctctggttccatttgattactaaaaaactgcaaagaacaggaggagaaagaagaagaaagctggtacaaacagtgaacttatataatattaatcaataattgtctcttgttcttaaaagcaatgggaagaaaatgagatttgagctggaagatcagagttcaaaatccaaataaagtatatggccctaatatgcttatagtagttaacctttcctgataatgatataattgttgacagcaccatctttaaaaataaaaataacatagtaatccttcagatttgtagaatgctttcctgtttacaagtttgttctatacacattatgtcttttaaatgacacactagccttctgagggtaacttatattggcaacagttttcagatgtggaaactgtgaagacaatgttggtgatgtggaagcaacataaactttggagtctttcagacccaggtttgaatgtcagactgctttttattcagagtaacttcagagcattatttctcaccttaattttttttcaggcctctttgtgtctatgtgtcctcttcactcctgtccattgttcattcagtgatttttgcaccttccttcactgttagtgtgtagacacatagttctcctggctctgagacctatgttaattccattctaccatcctgccagcccactcaattcctattgagcaatgctagttgaaagttgtggtgggattaaatgttgcaatgagtattcaaatgaggttgaagtatctacgcattctacttacatatggtgaggtatattcaaggaaggctgtagccattaaaatctcaggaaataatttttcacctcctcaggtgaaagggtcttcaggcctttgtgttctggaaggttcatttatagccatttcccaaatgacaatgcgattgatgagtctagagtctagctcaaatagcaatggactggaagactagtttaggttttactaatgtggaacatagaacaaattatgtccttgtttcagcctgttcatctgtgaaatagagcctatcatatccagtcttccttgcctttaggtttgagttaccttctttggtcaaggtaagtaaatgcctatgatgtttggctgtgcacaagataaagctacaacaaagctacaacccatcttttctctgtagaagactgcaaaaagcaaaagagacccaggcaaaaatctcggaatgacttttggaacagagagcctccccagaatcagaagtcaaaggaatttaaaacatagggaggcccagggtctctactgacataaaggaaagatgttttccttataggtttacgtttacattttctctctctttccattcccacttgcatctccacctttacacagggcttatgggacctcctccacaaaagagcagttgcagtaacccacatcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaacacttacaaaaaaagtccaaatgaggaccttccctccagtgaattagctgtggctttctcacagtccatagttaggataaatgtaaagccatttctcatttttctccgcactttccaagggtacactccttgtttccaagatggaatgagaaataaagaagtgcccttcctgccatcttctcccctgaccctttcctccttcccactttcctcctattcctccccaaacatgatttatttctgcgttttgcaactcttgagttctcagcatttagtaaatggtgttggtccctgttgattccttcctctcctggaccatggaaggtagtaggcctttcagaaatttcaggtagcagccaaaccccagaagaagagaaggaacacagagacctagaccatgtgagaacctgaggtgtgcagcatttacttcacagattcgtctagcatatttgagaggtgtctttcctactaggagactgaactctgcatctgagaataaaaacttaacatatctacaggttttgacaacctctgtgaattatctagttgagaggatggctcaaggagcctattgccatggtctgatgtcgttatggacgctatgaacatccttgcagtttccattgttgaagacagccctgatgccagctgtctcatcattccccatgttcaagagcatcccagcattgctacctcaggatcccatgtcctgaatgcaacagagtgatttcgctgctgaattactattcatggcatggctcttcacagcatttattcatccatgtatctatccattcatccttccagccagccaagaagttcacgctttcatcttttcatccatttactcacctatttattcatttagcaaatatttattgagtaccaactatgtgccagacactctgctaggcattttggggaagcagaactgaataagatactattcctttcctcaaaaatttgagcaagaggagaaaggaagtaatgaggaatattccttagccataaaggaaaaataagaaatcacttggaagaagttaggtgagatggaaggaaaaggacatctaaggtaaagcgtacagtttgaataaaggcacagagacatgaacaaaatgcattgagggtttgaggaacagcaattggtttaacatggccagagctggggaaatggtaagggcaagctgaaaccacattgaaagcaaacttggttattatactaggtagtttagacttcaagcagttgaaaatctttgagcatgggataggcatgatgacattgtgtttatttgcatgtttctttaaagaaaactggcagcagcacaaatgttttgttgatgagggtttaaattgtagaaagtgagacaattttaggaaggccagctagagagaaatttctagcatcaaattttgctaaacacctaggatttgtagttacctccatttgggttgttacctgcaagtactgaccacgtatatgaagaagtactggtttagaccaaggcaattggcttgtataagaggcctaccctcataccaaaagccagtttccttggtctaggccagtgtttactggtatgtgtcctgagaaaactagttccatgacatgttccatgaaaaatatgatttctattgtcaaataagtgagggaaacttgcatatcatggtcctgctcaggaagatttacaatccttattagcatatcacaggtcctggtgaatactgcggtaaagtaaccgaggagctttgtaactcaggattcccgaagttgattcaaccacaggacctcatttattcacataacacctgttatcctacaaaaccactgttctctggaatacactttcgaaaacatgggtatagacaaaaactctatcctataggcagagaatacctatacctctagctcaggtcatcattttgcagatgtgtgtgtcattaagaatcagtcaataatgcattaatgatcaaaagcagaccatccttaccacatggtgcataagattatgctattatgctattagctactaatgccactaaagttaattatgttgggtctgcaacgttgtcatacacaaaggataggatgcaaaactgtcctaggccaaagcatggttattgcccaagttatctaatgtctgcaggtacatattcctggcctaaggattgtgctaaagaagttatttctaagaaatatagtgacttccagcatcatgcagaatgaccatttaatattttgaatatctagacattctgctgtagaatttaatagtccttttatacactgtctgaccaacattttgacatttactcagaaccccatcacagtgctaccacataacctcattgctaaagtgggaggcctagaaatcacagatttgtagaaaccatccaatgattgaatcccctctacttcctgttcagcaggcagcagagtgtcataaagaattaacaacgtggaactcagttactgggatttcttccattctcctttgattctctagactagaattccaaagaccctcaggctggtgatgcaagtgggaagtctcatttctgagaagtgctgcttcctacccacaattctttgatagctgagtgctttagctgatctgcataactgaggtgtgcaccaaggagcagaattactctataaattttggcatcaacatgtgcaacttgtgactcagcactttgaaactctggggatttttttgtttggttggtttttgttttaagatgtcctgtggtatagtggaaatagtacaatagactcagatacagagaggccttgtttctagtcttggttctgtcacttactatcttgatgtccttgcacaaatcaccagacctctctgagcctcagtttctccaaccacactgtgggaataataaaatcttttttacggcattgttgtaagtatgtagagaaactggtacacagtaggcacacaatcaatgtcaccgtacccttcagcccttcttttgtggatgaaaaatggtctttgtgctcccagtcaccactggggtctgttctctctctctctgctgttacagtgtggcttttggttcttgtttctttgttctttggtctgtaaattacccttgaaacaacccttgaaatttccactccatgacctaaatcgtcatccctaaattggttacatacatatttggtgacactttggaggggaaaagctttatgtctctctaactgtagttcttaagggaatttgcatatggaaaaaacagagactgcgtctcttaattcctccaaaccaaattatctgggatagcacatatatgttgtactctgtctctgagcatttgctcttagagaactatggttagagcgaagtaaatttttctaatcataaaaattaatgataccgcatatctgatacttgaatgagtacctccttgtaaaatttatacttaaatccttgagtttttaaagtgtaatagcaatagaaagattttattgttgtttacttttactgtgagtgctccaaaatccctcagttgctcttgaaagagcaagatgatgccataggcaatattttccaaaggtagtaggcagaaaactgagtacacagcacacaataggccatatatacaaaagcaagtattttgcaaataataataattcaggaaaaaagcttcactttcgttggtaacctgtttgtttaaaaccattttattatttattatttaaaaagagtgtcacttgttacagattgtgggatgtgttccttaagatcacaaaaatgtaaaatattttctttttatactgaacacatgcatagacaacttacctgagcaagctgctttttggagacatttgcacatcttttgggatcacgttgttaagaagtagaactaagggaaaaacacgcagccacccagaaatcggtagagccttcagctcatctgttattaatatttctgtgacaacagatatctaggaagtaaacaggaaattgcatcgctatcctgcatcaccttttttggaatcaggttccattcttctcagtccagttcaaccttgtgatactttttagatctcaaccaaggcatagaaatatattttcccttgcttaataccccatggaaccaatgcccctgtggttgaagtaaaaattgattgttgagggacatttcagccctctagcagtcaacaattaaaaacatgtaagcaccgagcacctgcagaaaacttggactggcatttggatctaagaagaaaatctgcatcttgaccaagatgaaaagtcaccagcccaagcttgtgcagtgaagtgtcatgttggccacaatgaaactgaaagagactgatgactctcctcagggtggaaaatgaggcatggaagctttgattagtgagctgttaggcacacagacattaatttcaaagcattctcatctccagtctgagtaataatgcttatagtattatgcaattgtttggctgctgcaagaaattcagcagactccaacaagtagtctttcttggtctctgagtgactgtaacttaaattctacctcccttctcttctcctacatcttctcactccccaccccacccccacatacacacaattcttgtccactatgttcagagagatgcacgcacacatatatatgtatatatatagtatatttgtcaataaagcagaaaagaagaaaaaactccaagtaaacaattttccatttccccatctcacttctgtcttacaagtggataggaaaagaaaaacccccagtaaaaaatggcaaccgcccacctccccaactttacatgctgcttcctatgttagaggatctgtcttaggcatctgattatggagcctgctagatacaagcccgtatttagactgctacagtcaacaatgtctctctttcatactagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacaccaatcgtattttcttatttacaacagactgagagaattaatgctgttaacattggatcttttttcttttttttttttccttttttttctctctcgtttgctttccaggtcatgctgacctgttcagcttggactgtttcacatttgtttttaatgtcagtttaaatgtaattgtaaaagcatgtatgctctaaaatcatgtagttacttttttcagtggaaaagcctggtattcgaaagcatttccaggctctgcaatttcatatgagcaggtttttggtaaaatcttttgtccctcactcagggtggtatctggacagtgagcccctttcttctggctcagtagtcagagagaggagacttggagacagtttctgctggatcctgtgctttggcaaggatgtgcagcattgcatatcattctatcattaattatgtttactcctccatgaactaaaaaccattagactaaatagtccaacataaaccttgaaagataaaatttgatattcttttgcctggccatttctctgacccagaattggggctgggaggggattggagacttgggggaaagaatcaaggagccttcttgcctgggggaatttggcatgcacttattaatcccatttggttgcactccctactaatccctcactccatacctgccaaggattggctctgctccctgcttctcatccctgtcctagttcttcctcacctatctccatttcccactactgatccttctctccagtaagatgctattcaacccgatgaaatataaagagtagcaccaccctggaagtcaggataccttagttttagctcctgctctaccattatctagctgtgtgacctggggcatgacttaacctttgctcttcagtctgaacagtctttaagaattggtttggaggaggaaggaagggatagacaagatccaaggcctttgaactcttttttggaaatgggtccttttcttcaaacaaaatttgatgcagagtcccaaatttacctacagaataaaatactgctgttcttgtttgaaaggaagtggggtgcttggagccacatgctcaggcccactttgccccctctcaggaaccctcgaaaaaacttataggacttataggactgttggggatctgccaagtctctcttatgttacatttcagtccttgtgaaactctatatgtttcatcagttcactttttcagaaagttcacctgcttggggtaaaggtcatgaagtggagaatgtggggctcagtaactagcaatagtaaaaaacatcattgattggcttgcagaatttactctgttctaagcatcttacacacatactcatccgaaaactcacaacaaccttgtgaggtagatctgttattatcttaagattctgaaacctgccagcatgactctcaatctttgacttgagaccagttgcccaacatggaaggttatacttttcacagtttaccaccataagcagtctttcagagtgatttctagctagagatccattcttagaaaaagtcagaacctgcccattagcatacactgtcacatggtgcagagtaccttcactgggttcatctcatttcctcctaaaaatagtcctatgcagtagtccagtcatatcatcaccattatatagatgagaaaaactgaggtgtaggagaaatcaagagatctgttcaaggtcacacattccataagactctgaataccaccatcaagaataataaaccttttatgtgaaaagcattttagaacttcagtgtcattattgcattctgcctcctggagttcagtgcactttttcaccatgctttaatcttggagtcctggtggtacagaatctgccttctactctcagacaacaccacagtgtctttatccctcataacaaacttatgaattaagtaatgatattatccccattttacaaattagttaactgagataccaagaggctaagtcttgcccaaagtcacacagctagtcagtgatagagccggagttacaaatgaggcatcctgactccagaatatttgctcttaactactactctttatacatatgtaaggaaactaaaagcaaaagagggaaagatgtccctgaggccccacagtgagctcccctgactcacaatccagtattcctctgaccttctaatcctaaagttatacagtaaggtcccttgactctaatcctagtagatggaaagatggctggcatgatttaagccagaggccacaaactggcttccccagagccagaattcacctgcagaattctgtttgtccagcacagtgtttgtttagaaaattgacgtagactgcccctaggcagggcatcaatcactgtcattgtccccagccctccttatttatgtttgccaggcttttttactcatttatgtgtctgcctgacttgtgaaggtatttgagtttatgacttttagatttaagcattgcaatatataagcactgcacacatgcattcacaaaagtatagcctagtctagcttcacaaagaatttgtagccctacaccaaacacacctttatgtttacttagtgtttagaattagatttaagatcagaatttagtttcacaggcattcatgtgtggaagaacctcagttattgttttttgtttcatactgtctcacccttgctttccctgctgtgtctggacccctgtcaatcctgctttctgccattcttcatgcctgagttagggcccctgcaagccattcactggttaatctttaggaatgaatggagagtgaaaaccagtttggagggttcactgtgtcccaagcatcctctcatttagttctcataagtgtcctaagagacaggtagcagcacattcgttttataaatgaggaaactaaatctcagagaagctgaacaaagacctcaaagtcattaaggtagtaattaacggagccgggatttgaacgcaagactgttggactccagagcctattcttttgccctacaccacagttccttacaaggaagatgtattcattttctattactgcataacacattgccacaaatttagcagcttcaaacatttatcagctcactgttttgtaagtcagaagtctggcacagcatggctagattctcagttcagggtctctgaaggatgaaactgatgtgtttaccaggatgcattctaatctgaagctcagggttctcttccaagctcatgtaattattgcaggattcagttatttgtggttgtaggactaaggctccctcttcctttctggctaccagccaagggccattctcagctcttggaggctgccctctttccttatcatgtggaccccaacgccttcaaagccaacaacagagactcttccttgtgttgaatgtttctcactctacggatgtctttcctggaggatcccagtcccgtaagggctcacctgatgaggtcaggtacatcaagaatagccacccttcaaattcaactgaattagcaccttcattacatctacctagcctttttacaacagcatctaggttagtgcttgactgaatgactggaaactaaggtctcagaatctcggggaccgtcttagaagtcagcctactacagatgttgattcttttcatgtgtcaaatttcatagtgagatagggagaacagaaacatcacatccttgaccttaggtaaagggattcaaacttcctaagactttggaaacttcacgccactttcaccttttccttaatcatggttgagaaggcctatatcttggagtggccaggagtgagactggaacagtacctaaaggttaaggacgctaaagaagttacagattggttacatctgctcctccctaggaatgatccatggaacctgatttgaaatttttttctctggtgctatagatagctcccacaggggtctaatgccccagggctgaaaagttagttccccataggatccatccaggcatgatatcaggccaggtgttacaatctcctaaagaggaggtatggactggaaagccccttgccaatggccctttcttgtcactgctctgacccaagactaacagggcagagatagtgaactcacatactattaaaactatccacttatacttccccctttctctttgctttatcactccatttaagtaaaccaatgagtctctgccttgacacagtggcaagctgacctgtatcttatatgaaagaattagatttgactctggggctcaggtgcagagggcaggaggggcataaggatggccttcatggaagaaaagaagtccttggatactgagtaacagctgagactagcaagcctcattgtccaggattccaagtcgtctagcaacatcctggtctctgctgcagacagaacagaggatcccccggcagaatgaatggagtctgatttcaattacgttcagtatagtcactctctttaggcagagaagccagaacacctggtgcagctagggccactgtggtcacagggacaagcacactacctgggtcctggaggcaagtgggaatgcagtttttcttccttaagcagatgccatataggcctggggaggaggatgtgagaataccagccaagttctcattggcactatacagagaaaggggaattatttcatcttgatggattctccccacagtctctgcacatattgatcttacttgtaatgagtttgcttaggttcacgagtcatcatcccagggagatctgagtcattggtgggaaagtcgaggcgacagattatatctcactgatctcactgtcaccaattgctctgtgtgtccctccaccttttgaaaaagtccatggattcatttgtgtgtaattcatttggatttatttcttctttatcaatagctttagtggggtattgcaaatgggaaagttgccccagagaacagtgtacattcacagcattattcagtagaactttctgagatgatgaaaatcttctatatcttatgttgtacaatataatacagccactaactacatgtagcttttgaacactggaaatgtggcaggtgagactgagggattatatttttaattttttaatgttgtaattaatttaattttttaaaatttttgctttctattttatagtttaataattaaactaaacttacgtagcccacatgtggctagttggctactatactggacagtacaagtctagaaggatctcagagagacacatgctgagatacagcaggaataagtcaaaaagagagccaatgtaacatagggaattctggattgggaattagagccctggctctaatctcagctctgccactaggtgaccttgccctctctggcttcagcctccccatctttgacttgaaaggttaaactaactaacgtcgaaagtcccaaaatggtggctatggactgaattcaattttgggatacacaagtttcaggaattttttaaaaatctattaatgccttctaggtgtgtgtatgcacgcttgcagacatgtgcccatgcacaagcatgggaaggcagtaaggcattcatttcaattcaccagtgtactaaccattcacacacacacacacacacacacacacacacacacatgcacacacaccctactgtattgcctatgtagagcctgaagatcttttaatctgtcaccattggataagataatttctaaggacccttcctgttttgtcatgctgaaaatctttaagccactatagtgtcccaaatctattccagtttgggcagatgactggagtattctcatagcctcctgtctattcccttctggatttgatactagttatgaagtttggagtcaagggtgaagaagggaggcagggatgatataaccccagccccactcctcaactctgcttttgagttagaagtagggttcagggcttcagattccttggggaggcagtagagagaatatgggctttataatcagaagatgaggttcagatgattgggttctcaccttttttatagctgtgttacctcagtttattcatttgtaaaatagggataagaaatatctttaacctcctaagatcatgtggaattaagtgatgtaatgtgatgaagcgaggcacgcagaaggccctgaaaaaattagtagttacccttaaggggactaaatggtctggcaactcccgagctcaaagctagaaaggtccagtaatggggaagatggggtctttctgtaggaactgtagcaggggagcagatcctgtaggccaccagtctgtggagctgtgtccaagaactcatgtttgcaataagcccaccaaatgacaagttattgtggggttcaggcctctaactcaagaagatggtcttggcccagatcataccttgcagcctgtgcctttggtgggatgtgggtgttggcagtggctatgcatatctccttattactggctgtgccaaagccccgcagaaatgattgttggacaaagtcatcttgcactcagggctggttttccaggcttccttgttattttcccctgagttcttctgtgttcctcttgcaacaccaaccccactattttcctcttccctaccctagttgttggtccaaacatgtaatccattcttgcagtgatttattgggtgacaccatgactggagtttgcattgaaggacttctttttctaattagaactaaaagtcagttccaggctgggtgtggtggctcacgcctataatcccagcactttgggaggccgagatgggaggattgcttaaggccaggagtttgagtccagcctggacaacatagtgagatcccatctctacaaaaaatgttaaccaggagtggtagtgtacaactctggtcccagctacttgggagactgaggagggagaattgcttgagcccaggaagttgaggctacagtgagctttgatcgtgccactgctctccagctgggtgacagaggaagatcctccttcaaaaaataaataaaaactaaaaaaaaagtcagttccaggttgtatcttttttcacaggggccagacacagatgagagcaggttttgttgtatttatccatttaaattgagcaataaaattctctctttggtttctacctttcttatttattattattatgttaaagggattaaagtggttcatggtctttctcagtgcaactgcttatgctagacctcagaattatgaccttttcaattatttatatttctgtctatataaatactggaaaaaatagtacaaagtaagcatcggaatgcctaaggacctctaaattgtgtgtgtgagcacatggggaagatggttcttaaggtttgagttttggattattgtggttgtcttaaataatgttatttctatcattctttccaatgactgtctcctagcatagttcccattttacagactgatggcagaggcagaaagattctctcacttctttgatactattgaggacttcagcctttcaccgctcttctcccctttgctaaaaaagaaaaaaatcaatatgtatgttacagtgcatttttttaaatattttttattatactttaagttctagggtacgtgtgcacaacttgcaggtttgttacatatgtatacatgtgccaagttggtgtgctgcacccattaactccttatttacattaagtatatctcctaatgctatccctccacccttccccaaccccacaacaggccccagtgtgtgatgttccccttcctgtgtccaggtgttctcattgttcaattcccacctgtgagtgagaacatgcagtgtttggctttttgtccttgagatagtttgctgagaatgatggtttccagcttcatccatgtccctacaaaggacatgaactcatcattttttatggctgcatagtattccatggtgtatatatgccacattttcttaatccagtctatcattgatggacatttgggttggttccaaggctttgctattgtgaatagtgccacaataaacatatgtgtgcatgtacctttagagcagcatgacatataatcctttgggtatatacccaataatgggatggctgggtgcaatggtatttctagttctagatccctgaggaatcaccacactgacttccacaatggttgaactagtttacagtcccaccaacagtgtaaaagtgttcctatttctccacatcctttccagcacctgttgtttcctgactttttaatgatcgccattctaactggtgtgagatggtatctcattgtggttttgatttgcatttctctgatggccagtgatgatgagcattttttcatgtgtctgttggctgcataaatgtctttttttgagaagtatctgttaatatcctctgcccactttttgatggggttgtttgtttttttcttgtaaatttgtttgagttctttgtagattctgggtatttgccctttgtcagatgagtagatggaaaaaattttctcccattctgtaggttgcctgttcactctgatggtagtttcttttgctgtgtagaagctctttagtttaattagatcccatttgtcaattttggcttttgttgccattgcttttggtgttttagacatgaagtccttgccggtgcctatgtcatgaatggtattgcctaggttttcttctagggttttatggttttaggtctaacatttaagtcttgaatccatcttgaattaatttttctataaggtgtaaggaagggatccagtttcagctttctacatatggctaaccagttttcacagcaccatttgttaaatagggaatcttttcccaatttcttgtttttgtcaggtttgtcaaagatcagatggttgtagatacgcagcattatttctgagggctctgttctgttccattgatctatatctctgttttggtaccagtatcatgctgttttggttactgtagccttgtagtatagtttgaagtcaggtagcgtgatacctccagctttgttcttttggcttaggattgtcttggcaatgcaggctcttttttggttccatatgaactttaaagtagttttctccaattctgtggagaaagtcattgatagcttgatggggatggcattgaatctatgaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctcttagaagcagttgtgaatgggagttcactcatgatttggcttctgtttgtgtgttattggtgtataagaatgcttgtgatttttgcacattgattttgtatcctgagactttgctgaagttgcttatcagcttaaggagattttgggctgagacaatggggttttctagatatacaatcatgtcatcggcaaacagggacaatttgacttcctcttttcctaattgaataccctttatttctttctgctgcctgattgtcctagccagaacttccaacactatgttgaataggaatggtgagagagggcatccctgtcttgtgccagttttcaaagggagtgcttccagtttttgcctattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttctgtttgtatgctcaattacatttattgatttgcatatgtggaaccagtcttgcatcccagggatgaagcccacttgatcatggtggataagctttttgatgtgctgctggattcagtttgccagtattgtattgaggttttttgcatcgatattcatcagggatattggtgtaaaattctctttttttgttgtgtctctgccaggctttggtatcaggatgatgctggcctcataaaatgagttagggaggattccctctttttctagtgattggaatggtttcagaaggaatggtaccagctcctccttgtacctctggtagaattcagctgtgaaatccatctagtcctggactttttttggctggtaagctattaattattgcctcaatttcagaacctgttattggtctattaagagattcaacttcctcctagtttagtcttgggagggtgtatgtgtcgaggaatttatccatttcttctagattttctagtttatttgcatagaggtatttatagtattctctgatggtagtttgtatttctgtgggatcggtggtgatctcccctttatcattttttattgcatctatttgatttttctctcttttcttctttattagtcttgccagcagtctatcaattttgttgatcttttcaaaaaaccagctcctggattcattgattttttgaagggtttcccatgtctctatctccttcagttcttctctgatcttggttatttcttgccttctgctagcttttgaatgtgtttgctcttccttctctagttcttttaattgtgatgttagggtgtcaattttagatctttcctgctttctcttgtgggaatttggtgctataaatttccctctacacactactttaaatgtgtcccagagattctggtatgttgtgtctttgttctcattggtttcaaggaacatctttatttctgccttcatttcattatgtacccagtagtcattcaggagcaggttgttcagtttccatgtagtagagtggttttgagtgagtttcttaatcctgagttccagtttgattgcactgtggtctgagagacagtttgttataatttctgttcttttacatttgctgaggagtgttttacttccaactcagtggtcaattttggaataggtgtggtgtggtgctgagaagaatgtatattctgttgatttggggtggagagttctgtataagtctattaggtccacttggtacagagctgagttcaattcctggatatcctttgtgtcttgttgatctgtctaatgttgacagtggggtgttaaagtctcccttgattattgtgtgggagtctaagtctctttgtaggtctctaagtaatcactttatgaatctggttgttcctgtattggtgcatatatatttaggatagttagttcttcttgttgaactgatccctttaccattatgtaatggccttctttgtctcttttgatctttgttggtttaaagtctgttttatcagagactagcattgcaatccctgcctcttttggttttccatttgcttggtagatcttcctccatccctttgttttgagcctatatgtgtctctgcacatgagatgggtttcctgaatacagcacactgatgggtcttgactctttatccaatttgccagtctgtgtcttttaattggagcatttaggttaatatttacgtttaaggttaatattgttatatgtgaatttgatcctgtcattgtgatgttagctggttcttttgctcgttggttgatgcagtttcttcctagcctcgatggtctttacaatttggcatgtttttgcagtggctggtaccggttgttcctttccatgtttagtgcttccttcaggagctcctgtagtgcaggcctggtggtgacaaaatctctcagcatttgcttgtttttaaagtattttatttctccttcacttatgaagcttagtttggctggatatgaaattctgggttgaaaattcttttctttaagaatgatgaatattggcccccactctcttctggcttgtagagtttctgccaagaaatccactgttagtctgatggcttccctttgtgggtaacccgacctttctctctggctgcccttaacattgtatccttcatttcaactttggcgaatctgataattatgtgtcttggagttgctcttctcgaggagtatctttgtggcgttctctgtatttcctgaatgtgaatgttggcctgtcttgctaggttgggtaagttctcctggggaatatcctgcagagtgttttccaacttggttccattctccctgtcactttcaggtacaccaatcagatgtagatttggtcttttcacatagtcccatatttcttggaggctttgttcgtttctttttactctttttttctctaaacttctcttctcgcttcatttcattcatttgatcttcaatcactgatacccttttttccagttgatcgaatcagctactgaagcttgtgcattcgtcatatagttctcgtgccatggttttcagctccatcaggtcatttaaggccgtctctacattgattattctagttagccattcgtctaatcttttttcaaggtttttaacttctttgcgatgggttcaaacttcctcctttagcttggagaaatttggtcatctgaagccttctctcaactcatcaaagtcattctccgtccaggtttgttctgttgctggtgaggagctgtgttcctttggaggagaagaggggctctgatttttagaatgtttcagtttttctgctctgttttttccccatctttgtggttttatctacctttggtctttgatgatggtgacatacagatgggattttggtgtggatgtcctttctgtttgttagttttccttctaacagtcaggaccctcagctgcaggtctgttggagtttgctggaggtccactctagaccctgtttgcctgggtgtcggcagcagaggctcagaacagcgaatattgctgaacagcaaatgttgctgcctactcattcttctggaagtttcgtctcagaggggtacctagccatgtgaggtatcagtctgcccctactggtgggtgtctcccagttaggctactcgggggtcagggagccacttgaggaggcagtctgtccgttctcagatctccagctgtgtgctgggagaaccactactctcttcaaagctgtcagacagggacatttaagtctgcagaggtttctgctgccttttgttcggctatgccctgcccccagaggtggagtctacagaggcatgcaggcctccttgagttgcggtaggctccacccagttcgagcttcccagctgctttgtttacctactcaagcctcagcaatggcgggtgcccctcccccagcctcactgctgccttgcagttcgatttcagactgctctgctagcagtgagcgatgctccatgggcgtgggaccctccgagccaggtgtgggatataatctcctggtgtgccgtttgctaagaccattggaaaagtgcagtattagggtgggagtgacccaattttccaggtgccatctgtcacagctttgcttggctaggaaagggaatttcctgaccctttgcacttcccgggtgaggcgatgcctctccctgctttggctcacacttggtgcactgcacccactgtcctgtacccactgtccaacaagccccagtgagatgaacccggtacctcagtcggaaatgcagaaatcactcatcttctgcgtcactcacgctgggagctgtagactggagctgttcctattcggccatcttatgaatcatgcatgttcaactatgagcaactatgtgtattcaatgggaaatggaataccataaaattgtcatatgttgagcccaaaatgataggatagaatttgatagtctgaggatggaaaggaccttcaaggccacttttaaaaaccccattcccatatgatgcttgaattcttaaccactgtgtgtctagtattttctcatttccagtgatatgtgtgcctgccaacctttccgtctccaagagctttaactatcaaaatgtatgtgtgtgtgtttttgtgtgtgcatgtgtgtgtgagtgtgcgtgtgtgtgtgtgtgtgtttagagagagagagagagacagaaagagaaggagagactaaaatccaattcactgttctttctgggacccaaagaacaagtctagtcattctccatttctagtctctttccctagcaatcggctagacatgctagacatagacacatgtacatcactcctttgaattacaacattcagtatttgtctatcacttatatgataaaatacaaacttagcttttatttttatttttttagagacagtgttttactatgtcacccaggctagagcatcagtggcacaatcatagcccactgcagcctggaacccctgggctcaaggaatccttccacctctgcctcctgagtagcagagactacagatgtgcaccaccagacccagctaatttggttttttactattttttgtggagatggtgtattgtcttgtggtgttgctcaggctgatcttgagctcctggcctcaagcactcctcccatctcagcctcccaaaatgctgggattacaggcatgaaccaccttacccagccaaatttcttaatatgatatacatgctcctttaaaatcaagcaccatctttgctttcaacctcattattaaccactttcccatatatgcaacatatgtttcagccatactagtgtctagtttttccctgaacactccttggtgcttttgtttatgccctttctgcccacctttgcctggtgaaatcctcatcaatcttcaaattctatcaaatactatcttccatataaagcattttctaaacccacctatgtaaaaagattagtgttttcctattttgttgatgcctccattgcagcattttccagtccaacgttttctagaattgattgtggccaggctaccagactgggccagggcctgtgtcttttctgtcacccagaagcaaaggtctaacaatggatatctgctgaatgaatgaacgaaaatgaatcattaatatattagtaaatacgttaattaaagttccaggtatgaatactgaaggctgcattcaggcagagctggatccaaggatatgctaggttggtctagcacaagaatcagagttttcctctgcaagctatgaaaaatttgggtttagcaggtatttgggatgatgaattatacatttaaccagtgttgaatgagcacttgtccttaaggagtttagagtctgtgaccagggagaatggtgattttcttagctagggcagtttttctaaaaaggtagttgcattgtgtgtttttgaccactgatgataaattcaagtctctcttccttcccaatagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggtaaggaaaagggaagtgggagcatgagataagggggatcatatttagtgaacgctcctatggaccagccaccatgtctggtgcttttctgcccattaactcaggcagtcttcatcataaccctgtgggagagggattgttacaagtctcaatttaaacatacagggatcgaaactcagaaagcaaagagaaagatagtattatcgggtgtcttatgtggcccacattgatgcacagcagtcatgctttcatattcaactcacaaaaatggtcagcaaattttccattaatcacaaatcacatagacatacccatatatgccttaggatgctcttctatatttgcacacacaggctcaccccaaagataatctctagtttgactgacattctgtcttcaatgtcatctttaggagctatatcatgggaactctcataatatggtatggtggaaagaacatgaggttgggaatcagaacacttcgggtctgctcttagctctgctagtaacttattgtgtgatcccttccccttctgggtctcaatttctctatctgtataatgtataaagcgtggtttgtatcaaattgatggtttccagtttttgaaaaaaggaacgctttttgcaccttaaactacctaaggaatcataatgagaggaaagattaggtaatagtgaaagaattaccaagtgttggtctaacagaagttggataacagaagttcctcagtgatggggaactcacttctttcttatgtcatctgttgtttaaacaagtctggttattaaaatattacagcttaaggaattcttagagatcctctatccaatgattcacaaactttcctttagcagccaagtgctttatttctcaaaagaattgtacacagatacaagtggagctagtttatttaaagccagagcctgtagcttgggcctcaccagttcagcctctttctctctatcccagggaagccctaggtcactcttgcaaaatcttagggctccaaggaacacagtttgaaaaccagtgaagtatatgccctttaaaggttctcctaatcctgcaattatgattcaaagattcttttgaaataacaacaaccaaaccttctcttgtggagtcaaagattaacctgcctttcaataataactgccattcaggtagaaatttatagtgaacagagcaattttgtatgtattacctgaattgattcttataggaatcctataacatgagattctttctcttattttacagaccaaatagggaagctgtgagaatgatgtgattggcctatagttacatagtcagaaaatagcaggaccagaacttgagcccaggttctctcctgattccaaattctctctattccactccacctgtaggctgtagcaccactgcagttctgtagctctgggctttacagtgaggggccaaggcttcattgaaggccacttgggtcatagtatgggcttgttgcatttgaagacatttcatgttggctgtcaagtcttagatttgtatttccaactcacagggcctggtcacagccctaaccatctcttataccttctcagcttgggaagctgaggtcgactagccaataagaacactgggaaggaaacccaaggactctgactggatatgctctgtgccaaaacagagggttcactcagagaggaaaaatataaaaaagaaaaaggagaaggttgctttaattcttatcactttttcatctggatattttgatatcatgtgtttgacagagattcaaagtttaatcttcccaagcagtttccaaacacttatctcattttataggctacagagctttttcatatatatgatcccacttaatctttacaacaattctatgaatcatagagactattatttccatttcacatgccaaggctcaaagaggttaactaacttgctccatttggtcacttaacacatggaaccagaacttgacctagaccttcgggtttctaaattggttatcttgacaataacctagtgcaaaacactatagcagaatttgtatgacttgggatcactggggctttccttggcccaaccaccaagatggaaagccccctccccttacattaacaaatctgcaagccaatatcagttcaccatctagcttgccagactaaatgatttctgaccccaagtcttttaaaagaatagcttcaaaagaaagccaattaccacattcacaagaactgttcttcatattatctataattacctacaagtacaagtaatttgctaattcaatagattgagttcttgacctgtaagatgaactgtgctaggcccctaataagataaattttgttttaagttttctgtgacagtaaagatgtatgaaaattgcctagtagagtacctggcacattaataaatgataactgttaatttggagtgggtgagtagactgggtgtgcacagtatatttagaatcaaatttatctggtttggaatcctagctatggactagttctgtgaccttgagcaaatcacatgtcttctctgtgcttctgtgtcctcatttgtaagatgatagaataatcactacctttcaaattgttgtcaacaaaaagattatgtataaagagcacctagtaacgtagcctgaaacatagtcaatgctctgtaaatggtggtttattattatgagacttgaatgctaagccactgctttcacgaaactcaattttagctaccacttgccttgcctagaagctcatgcatggaccccaaggtgaaattgtgttctctgaagacctcggctggcagatgtactacagcagcaaagatttccaaactggcctttctttgagcccattctcccagactagacaggagactacaagtttctgctgcacatgaaaaaaatatgatgtcaatcggattctagtgagaaaacagagtctcaaagaaactgcttctgctccctagcgtgtttaatgtgtttcagaacctgagaatgactcctctctgtttctccagaacagcctaacacagtggcaaatgggtgttgagtgaatgcatacttaaggaaatctgtagggttgcagctactctttcctcaagtaatcccttgatagtcatgtaggctacttcagagattgggcattagagaacagagtcaggtattataatcagattagactctagggaggttagccagccatattgctgatatgtgcacagttactgggtttgagtgctaagcagctctcattaaggacggttaattaatattatggccaaattaagctttcccttttctctcctctttgttagttcggtggcattttagggagaaaaaaataagcatcagtatggacaatttgcttgatacctgtacaatttaattctcatccttccatgtgccttcacattcacacattccaccagaagaccaaggttcaccagccaaaagcttttcttgctccccactgcctcctacccaagatattcagggtcaacctcccaggcctcttctctaagagatccttggttgctacatgcttagaccctgcttcttatttcctgctgagaagggtcagtccaaggcattctgtgctacagaagggttccaagcaggaactactctgggatctgaggctccagccggtctgtcagcgtgtcattacagtgaaggtgggaagcacaggcctgggagctaagactgctaagatgagggactctagaatccctgatacctggaaggcctaggatctaaaagaaaagaacagggaaatggggctatatgagtggacagggaccaaccaagcagaacaatgtgtctggataatgtagacttcagacctgatcctatggctgacaaaagctggtgaccttggtagttcctgagctgtaaccttcattagtggagtagaaaaaacactggagaagagaatcagaacacctgggttctagtattagttcagccacatataaaccatatgaccttgggtaagtcagtttatttctctggccctcatgttccttgttggtaaaataagtgccacatcacctaacctctgggattattgtgagagttaaattaggtcatcaacaggaaagtgagaagtttgatctaaatttggggaagcattcctaatgaggtatgatgacaaaatttcagataattctggatttgttggtgagaagagagagtgttggtagggacgagctctgaggtgatgcctttataactttaagcatccaactgtttcaaaaactccaggagaacatggccatgtctgttctacctgtgtattattgtagacgtagcttctgggagcctctgctctctgagcttaagggaggtaatttggagatcatttaattctcattttacaaaaggaaaaaaaattgagggtctttaggccatttgtttaggtaatatttcttaagtgcccactcaaatacgtggactgtactaagtactagggaggtaaagataaataagaagatatggtccctgtcttcaagaagctccaagtcttgtgggggagacagacatgtatatacatagacttcaatgctgtgtaatgactgctataattgggtgaggctacacaaggtgcaatgagaatgtaaaagaagaatctttaagccttcttcttggatgagttgggaaagccttcacagaagaggtagcctttgagtgaagacttgaaagatgagtagtgtttaccggatgaaaggcctgagaaggaggaatgcattctaggcaaaagtaactgcctgtgcagagataacagagatatagaggcatgtgagagcgcaagtggcaagagatcagtctaggtaggcaggtcataaagggcctattcatgtataatgatggcagtaagatgaggatggcagtagggtgggaaattagtagggccagggtacctattgagtagaaaagaatggagaggaaatgccaggcagaaagaggatggacgcaagagagggaacatgaaagtggtgaacaggtggcagtggctgtcaagacatctctccataccctgtacactgtatgtaatatccatctcccagggttgttagaagggtcaaaccagatcgtagctggaaaacagctttgtgaagtgaaaactgctgtttatgtgggggaaatgattgttaaactgcatctttggaaaggtgaagtgatcaagagcacagaccttggaatctgactgctttgctttgtaacttggtctgccaattactagctgtatgatcttggacaagttccttaacctctctctgactcacttgtactggttcacagaatggagataataatagtacttaccttactcattgttgtgaatgttaaatgagataatataagtaaagtgcttagaaaagagttaaatgtaccccataaatacatacaactatcatgtacccaaaattatttttaatttttttaaaaaagagcaatccaatagcaaaagaaaaaaagagttcactcatataagcagtcaataagtgttagattatttttctcttacaactgacaatgccctttttgtctccatcatcatctcatttgagcagctcagggaagtagggaggataaggaatattatcctcaccatatagtttgtgcttttccccaccaccccttaatggccagcctggatggtccctggggatccttaggggatgcccgaataccagagcatctctgcccaacagggactcagacttagctcaacccgtcagtacccagactgaccactgcctctgcctcttcttctccaggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaagtgctcctggggcccagacctcactaaaatacagcagcttggccagacctggttggtggtgatggtgatggggtgacagtgaagcttagctcatttgatctgcagttgtcgcagcggatgccccagccagccaatccagtatgaggcggctttgccctggctttcagccaactggcaggagcccaggaggatggtgctgagaccacccctttcacacccaagaaccaatcctagtcatatttctggtctgctttgcagcttatctcaaaaccacatggaaagattcctccccttcacatataaaagaggcagaaagactctggctttaagggctggagtttcttgggttcttttgctaccaccaaaggctacttctagtcaccatttgctgagcaactagtttgtgccaagactatgctagatactttctaaatcctagctcattgagtcctcatggtgacctgacctcacctttttatagataacactatttttttatggatggggaaaatcaggctcagcaaaataaagtgactcacccaaagtcacagagctagtgcctgttggagacaagattcaaacgtatgtccctgtcgatctcagctcttctgcgtcatggtggtaactgatgggaaggagtacctctaccgctctctggctgtgtgaccttggtactgccattttccttcccttaaacagctttaattaatacctgccctgccaccagctccatataacatcatgaatttggccagtggctcagattttggaattacatttttctccactaaaatctcagttctactattttcttagtcagcatctttgggaaagacctttaacttttccgaccctcaatttcttcatccattaatgataacagaaccttcataagtaatttcttatgataactaaatgggaattgacagatgtggaatgtctggcccatagtaggcaagaaggaaaaaaaaagtccctttctgattcaccctttccctaatagtgatacattttttttccccgagatggggttttgctctgccacccaggctggagggcagtggcgcaatgatctcagcccagtgcaacctccacctccctggttcaagcaattctcctgcctcagcttcccgagtagctgggattatagatgcccgccaccgtgtccatctaatttttgtatttttggtagagacgggatttcaccatgttagccaggctggtctcaaactcctgacctcatgatctgcccgcctcagccgggcatgataatcttttctatgtctgctgtatgaggtccctcgatggcattgtgaatggagctggccagagaaatcttcccaaggaccttgagctagtctcaccacagagaatccttccagtcaggacaggaattgaccttcccccctcttcagccctctaacccagaagagtcttaaaataaaatctacaggccaatggttccttccagtacagcactgcaatgcgagggagagtgagcgtccccagctgccctctcccaaccctgccagcctggtagccaaaagctaagaataaccactaggcttttggcacaaactgctttgtggttttcagatctccgcaaagttgcctatgatgccatcttctggggcaggccttgaaaagccccctaactgttcatctcccatccttaaacccctgctgcccttaagcagttgaatcaactccatgagcacctgctctaccttccccagagccctgagacctttggagctttgaaaagtgataattggttgttctctaaatcctcatttccttctctgcctctaagtaagcatgtggcatcccacctcggcttcctggtccagtcttgttcatcttataaaaaggcctccctacggggtcagaggcctagacccatcaaacccagggctcctgaaacaataggacccctattcctcctgtaggaagccactgtgttagagctctcagggtgtctacaaacatctagataagtgtttctcaacatggattctgttgacatattgggaaaaataattttgtcattatgtagaatatggttaacatacctggcaccagcctactctataccaaataggattccagtcattctgacagcccaaactgctcccacacatttctgacacccactgaagaggcagtactctccagttgagtgcaactaatccctgccagccttcctaaggtgctaatggggagcctcagacccaaagagagagagaagaacttgtccaatgtaggtcaacccatttgctgatctcttcaacaccaagctctattatcagccctgtttttttctttctttctctctttgtagagatcacatgttgtgaggataatgagcttgaaccttagctgtgtgaccttgggcaaattactgaacttctatgtgccgcaaattttatctggagactgctgaagagtattataatagcacctttctatatgtcatttattgaacacctgctatgtgtcaggcactgtgctcagtgttttccaatcttcatttctcctcttattttctctcttgcactcccaccaaccttgttctcttcctaaattccattcctgcctcatttttctaccctccattctcctctctcttccttcctttaactgtctccctagtatttttccccttttccccctttcttttccccttcccccatgaatttcttctctttcctttccccttctctttcctccattccccactttttctgcccctgaggcctgcagcaatgttaaaggaatcctcattccagcattgtgatttcaatggtaaaaagattgcagcattgtcatcaacagaggtgggaaagtacattggagactggagcagagccagacctcagggtcagccaatcttactaaaaaattctctacagtgaaagagcttggagcaacactgttctgctcaattgatttgtgataccatctaaacacttcctctttctagttgggcttcagcctgagttgaataattctacaccatctgccctcttctctctttctccaggacagccaagatctctctgagataggatgctgagcttccacccagacaataccaggcctgctcatcctatggagtaggctagtggcttggaaaccaaaatgtcaaaccatagcctttaggctccatctgggaggtctttgtcctcaccacttaagtgggtgtcaaatttccttccctttctgcacacgctgcacaatcaatttctgtcttacacacacacacacacacacacacacacacgatttttgaagtgctgaaaactggaaggcctactagcatgaggatgctgtgtcttctcttagaggtatgccatggtcagccatggaaccgagaggttgctcttccttgaaaagctggccaagcattggccacttccccatataatttataggtgataatgtggtgatctgttcagaagtgactataataaatgcaactcacatatgtctacagtttccaaactgtggtaaggagcagccagcatatgagggaatgggctccccttcagcaggggacatttaaactagacattcaaaaacactccctggcagatttaacattggaactcgttttgaaagaacaatgtggaatctccttcactgggagtttttgaataagtatgaaatttctagtattccaggccagaggcaaaggggtcaacaggatgaccaaacacttcgggtcatttgcaaatcttgatgtcctgatgttaagagctgactactggggcttctcctaaaaatccttcatgttgagctgcctggaaggcaggttctcattctggctgtagctgagatgttagaactgtagtcagggagaccatgtgcctcccccattgtgttcatttggttaggctttcctgtccctgactcagaaaacagaaggggcacagagacctggaaattccatgtgctaacccatatcctggccagagaagatgagtagttatcagggtgtcaggattttggaaaacagagagagaaaaaaaacaaacaaacagacaaacaaacaaaaaaaccttttcctggtccctggagcaccagcaggagaaacagcaagctcttcttggaaaacctggcgagggatggcaatcagagacattccctctgggcttattgtaaacttcccctcattcctttttcctctgtgtatctccttcccaggtaccgcatgcacaagtcccggatgtacagccagtgtgtccgaatgaggcacctctctcaagagtttggatggctccaaatcaccccccaggaattcctgtgcatgaaagcactgctactcttcagcattagtaagtgcctagaagtgcagggaatgccccctgagggcacagagattcagagaggaccacttttgccattaaaacattattagggaaaagccagctcctggacatttcccttcttcattccccctccccatccccactctactctctctcagcatcattttcctaacaagaaacaatttcatgactagaagccaatttatttgctagaagtcaacctccatcagattccccacctatccccagtctgtctttgggacaaggcctttttgactggttacagcaggtctctgaatttttccatagcttctgctatagaaacagacatgggccaccttgtattctttgcagggcagtagagcaggaggcatttcctcctggaaagatttcctcttctgccaacaggaggagatctatgtaagcaactcagataggatttgtatggcagccaaggaacttttctttaatatcttttctaagagccctctcttagcccctacggagggagaagggcaaaatttgatattcaaagctatgtgttttggttatctaaatcagggttttactgtgaatgacataaaagcttaggtcctaaaaaatgagtatctgagaagagtagaaaaagaaaaggttcaggaaatttgatttacttgactcctttcagatcggatccagctatcctttcccctgagatctccctgacagactgaaggccccaagcacacagacttcaactaacaggaagccaagtagatggttccctgtgggggtgggggtcaagtctgtggtcagaaaacttggtgctttgtctaatgctccttcgtgggcatgcttcccctccccattctgtcttcatcccacatcagttccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctgtaagcaaacgatggagggtgctttatcagggagaacagcctgatagagccaatgataatatgcttctctagagtctggcaccacctgttgggaggtgcttccattcccctctggctttgagtgtggtccaggaagaaaatgtggtgaagaaaagaacacgggtcacagtgtcccagctggatattgtgaaaggggtggaggagttgagaacagagcagttgggactcagggaagggacttgcagcagatgaattctctaggcagacaaaacagacctggatgtttttcccctcttctttgagtcatgttcatgtgagtttgtctgtctgtgtgtgtgtgtgtgtgtgtgtgtgtgtgtgtgtgtgtgtcagagagagagagagagagagagagatggagtgcggaggcttgggtgagagcacaagctggagaagtcttgagtcagagagcttacaatggtataagacatctcttgggagccctcagtgactccatggagaccatttctttctctctctctcgctgtctctctctaacacacacacacacacacacgacctcatgggggaggaccaaggaagtacggggaagggggaggaaacaaaaggctgaaagaccaaaaatcagaggttggggaagaggctagcagaggccacctccttgtcaaccctgtttttctccctcttattgttccctacagattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttcagatgaatgtcatcagagttcttttaattagctctttttattggctgtttttattgaagtcaagagttggtatcatgcccggttgcgttttatgctattttgattttcatatatttttaaaagtctttgcacaagggttacaaatttgccctgtggtggccttagcataagctgacctgggaccaccaaaataacaaggaatttgggctagaaagcacagatggacactggtgacccatcacaacttctcttgaaaaaccccaaacttgtcagctggggaaaagccacacaaagcccagctgcccaccttcacatccttatccttgtaggagcataaaatggtgtcatcactgcccagttctaaccaagcttcagttaaagaatgggtaccttcacatcttcactatttttcaggggccttaccgtccttgaccacccaagtaaaatctaaatcagccttcttttgggttcttcagttcaagcaaggcctcttcttgtggcctctcagtattaatatttatgaggttgcagattgaatttttgggcctgagatacaagccatcaatgaggtgtgacaaagcatgtcaatgaataataagaaaattatctattcttccatatcctcccctgtaataagggttgtcagaatgccttctttctgggctgggttgaggattcagtgagaacatatgtgacacagctggtgggctattaagctctggctttgctccctgttaaaatgccagaacccttgagagggatcccacattgagccatgtttatcactgaccaccttagaatggatggatttctcagatttttcctgagatcaatgcttgatggagaggagaggagaacaatagattcttgggatgtgtgttatgcatgtgtttaagtaagagacagagagtatgtttatttgcaggttgtgtgtgtaaagtcagagcctgcctccagaggatcttctctaaccaccattgcttaggtcctgttcgtttgcatctacagcgaatgaccttacagccatctgacttggcttcactcaccactcagctcctgcctaaacagacgaggtggttagcatccaccataagttttccaaggagtagcaaagcacaaaggacacctattgggttgaaaagagcctagaggcatgagtcctgtgtgtgacttgttcatagtcatgcagctagtgtatagctaggattctcccctgctgatttactatgtgacactaggcagcaatctgcccttgctggacctcggttttctaatctgtaaaatgtgtggagtaaaactacatgagatgggaagtcccttctagtgcagatgccatggttattgaaaactgcagcaacatctttcttaatcgtaaggggaaagaaaaagaccatttactactcctagaacagttttggagctagaatattcacatttgcactcaataattatttacaaaacaactagtgtggagagggtcaaaacaacagctgagtcctgtgtaatagatattgtcaaccccttgatggatgaggaaggggctcaaagggaa

SEQ ID NO: 2 - DNA, 6489 bp, Homo sapiens
aggtacctttggggctggctttctcaaggaagcccagctccctgtgattgagaatgaagtgtgcaatcgctatgactgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 3 - DNA, 14121 bp, Homo sapiens
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaacaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctcaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctgaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtagtggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttgacccaccaatacaagttgaaggagactattcagaagctaagcaatgtcctacaacaagttaagataaaagattactttgagaaattggttggatttattgatgatgctgtgaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtcgaaatgaaagtaaagatcatcagaaccattgaccagatgcagaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattactcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacacttgcacaccgtgacttcagtgcagaatatgaagaagatggcaaatttgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaaaaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 4 - DNA, 3964 bp, Homo sapiens
ctactccaggctgtgttcagggcttggggctggtggagggaggggcctgaaattccagtgtgaaaggctgagatgggcccgaggcccctggcctatgtccaagccatttcccctctcaccagcctctccctggggagccagtcagctaggaaggaatgagggctccccaggcccacccccagttcctgagctcatctgggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatataaaacaggtcagaaccctcctgcctgtctgctcagttcatccctagaggcagctgctccaggtaatgccctctggggaggggaaagaggaggggaggaggatgaagaggggcaagaggagctccctgcccagcccagccagcaagcctggagaagcacttgctagagctaaggaagcctcggagctggacgggtgccccccacccctcatcataacctgaagaacatggaggcccgggaggggtgtcacttgcccaaagctacacagggggtggggctggaagtggctccaagtgcaggttcccccctcattcttcaggcttagggctggaggaagccttagacagcccagtcctaccccagacagggaaactgaggcctggagagggccagaaatcacccaaagacacacagcatgttggctggactggacggagatcagtccagaccgcaggtgccttgatgttcagtctggtgggttttctgctccatcccacccacctccctttgggcctcgatccctcgcccctcaccagtcccccttctgagagcccgtattagcagggagccggcccctactccttctggcagacccagctaaggttctaccttaggggccacgccacctccccagggaggggtccagaggcatggggacctggggtgcccctcacaggacacttccttgcaggaacagaggtgccatgcagccccgggtactccttgttgttgccctcctggcgctcctggcctctgcccgtaagcacttggtgggactgggctgggggcagggtggaggcaacttggggatcccagtcccaatgggtggtcaagcaggagcccagggctcgtccagaggccgatccaccccactcagccctgctctttcctcaggagcttcagaggccgaggatgcctcccttctcagcttcatgcagggttacatgaagcacgccaccaagaccgccaaggatgcactgagcagcgtgcaggagtcccaggtggcccagcaggccaggtacacccgctggcctccctccccatcccccctgccagctgcctccattcccacccgcccctgccctggtgagatcccaacaatggaatggaggtgctccagcctcccctgggcctgtgcctcttcagcctcctctttcctcacagggcctttgtcaggctgctgcgggagagatgacagagttgagactgcattcctcccaggtccctcctttctccccggagcagtcctagggcgtgccgttttagccctcatttccattttcctttcctttccctttctttctctttctatttctttctttctttctttctttctttctttctttctttctttctttctttctttctttctttctttcctttctttctttcctttctttctttcctttctttctttctttcctttctttctctttctttctttctttcctttttctttctttccctctcttcctttctctctttctttcttcttcttttttttttaatggagtctccctctgtcacctaggctggagtgcagtggtgccatctcggctcactgcaacctccgtctcccgggttcaacccattctcctgcctcagcctcccaagtagctgggattacaggcacgcgccaccacacccagctaatttttgtatttttagcagagatggggtttcaccatgttggccaggttggtcttgaattcctgacctcaggggatcctcctgcctcggcctcccaaagtgctgggattacaggcatgagccactgcgcctggccccattttccttttctgaaggtctggctagagcagtggtcctcagcctttttggcaccagggaccagttttgtggtggacaatttttccatgggccagcggggatggttttgggatgaagctgttccacctcagatcatcaggcattagattctcataaggagccctccacctagatccctggcatgtgcagttcacaatagggttcacactcctatgagaatgtaaggccacttgatctgacaggaggcggagctcaggcggtattgctcactcacccaccactcacttcgtgctgtgcagcccggctcctaacagtccatggaccagtacctatctatgacttgggggttggggacccctgggctaggggtttgccttgggaggccccacctgacccaattcaagcccgtgagtgcttctgctttgttctaagacctggggccagtgtgagcagaagtgtgtccttcctctcccatcctgcccctgcccatcagtactctcctctcccctactcccttctccacctcaccctgactggcattagctggcatagcagaggtgttcataaacattcttagtccccagaaccggctttggggtaggtgttattttctcactttgcagatgagaaaattgaggctcagagcgattaggtgacctgccccagatcacacaactaatcaatcctccaatgactttccaaatgagaggctgcctccctctgtcctaccctgctcagagccaccaggttgtgcaactccaggcggtgctgtttgcacagaaaacaatgacagccttgacctttcacatctccccaccctgtcactttgtgcctcaggcccaggggcataaacatctgaggtgacctggagatggcagggtttgacttgtgctggggttcctgcaaggatatctcttctcccagggtggcagctgtgggggattcctgcctgaggtctcagggctgtcgtccagtgaagttgagagggtggtgtggtcctgactggtgtcgtccagtggggacatgggtgtgggtcccatggttgcctacagaggagttctcatgccctgctctgttgcttcccctgactgatttaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatgagtgggccgtcgcaagtgtgccatctgtgtctgggcatgggaaagggccgaggctgttctgtgggtgggcactggacagactccaggtcaggcaggcatggaggccagcgctctatccaccttctggtagctgggcagtctctgggcctcagtttcttcatctctaaggtaggaatcaccctccgtaccctgccttccttgacagctttgtgcggaaggtcaaacaggacaataagtttgctgatactttgataaactgttaggtgctgcacaacatgacttgagtgtgtgccccatgccagccactatgcctggcacttaagttgtcatcagagttgagactgtgtgtgtttactcaaaactgtggagctgacctcccctatccaggccccctagccct

SEQ ID NO: 5 - DNA, 533 bp, Homo sapiens
tgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatg

SEQ ID NO: 6 - DNA, 2480 bp, Homo sapiens
tttgcttcccctcttcccgaagctctgacacctgccccaacaagcaatgttggaaaattatttacatagtggcgcaaactcccttactgctttggatataaatccaggcaggaggaggtagctctaaggcaagagatctgggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacaggtaagggccaccccaggctatgggagagttttgatctgaggtatgggggtggggtctaagactgcatgaacagtctcaaaaaaaaaaaaaaaagactgtatgaacagaacagtggagcatccttcatggtgtgtgtgtgtgtgtgtgtgtgtgtgtgtggtgtgtaactggagaaggggtcagtctgtttctcaatcttaaattctatacgtaagtgaggggatagatctgtgtgatctgagaaacctctcacatttgcttgtttttctggctcacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggccagctgtgggtcctgaaggtacctcccggttttttacaccgcatgggccccacgtctctgtctctggtacctcccgcttttttacactgcatggttcccacgtctctgtctctgggcctttgttcccctatatgcattgaggcctgctccaccctcctcagcgcctgagaatggaggtaaagtgtctggtctgggagctcgttaactatgctgggaaatggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgagtgagtccaagctgttttctgatagttgctttagaagttgtgactaacttctctatgacctttgaa

SEQ ID NO: 7 - DNA, 1842 bp, Homo sapiens
cgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttaaattttttttttttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaggcaagtctctatattatgtcctcttttgtggtgtcttccatgtgaacagcataagtttggagcactagtttgattattatgtttattacaatttttaataaattgaataggtagtatcatatatatgga

SEQ ID NO: 8 - DNA, 18001 bp, Homo sapiens
gaagtcatcagcaatgcaactgttcacatggaggatactccctgcttgaggggtcagacaggcctgctgggcaacccaggaggcttggatgaccgtctaccccagtgtttttgggatggaaagttccacattctgagaaccctcagtccctgggcaacctggggtggttagtcaccacagcttgtggcttgggcccatgacagcaggtagaaatgacgtggactgccgccagccgggcacagtggctcacgcctgtaatcccagcactttgggaggctgaggcatgtggatcacttgaggtcaggagttcgaaaccagcctggtcaacacggtgaaaccccatctctgctaaaaaaaaaaaatatatatatataaattagccaggcatggtgacgtgcacctgtggtcccagctactcaggaggctgaggcacaagaatcacttgaacccgggaggtggaggttgcagtgagattgcaccagtgcactctccagcctggcaacagagcaagactctgtctcaaacaaacaaaacaaaacaaacaaaaagacgtaagatgtggaccgctggagaatgggggtgctgcctgcagtcaaaacggagtgggggtgcccagctcagggccagaatgatcctattcccggcacttctcagtgaggctctgtggctcacctaagaaaccagcctcccttgcaggcaacggcctagctggcctggtctggaggctctcttcaaatatttacatccacacccaagatacagtcttgagatttgactcgcatgattgctatgggacaagttttcatctgcagtttaaatctgtttcccaacttacattaggggtttggaattctagatcgtatttgaagtgttggtgccacacacaccttaacacctgcacgctggcaacaaaaccgtccgctctgcagcacagctggggtcacctgacctttctcctgtcccccccacttgagctcagtggctgggcagcaggggatgcatggccactggccggccaggtgcagctctcagctggggtgttcagaggacgcctgtgtcctcccctcccccatccctctgtcacccttggaggcagagaactttgcccgtcagtcccatggggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtggcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtgggggggtggggcctgggaaacagcatgtggggcatggggtgtgggggtgaggtgtgggaaagtgtgtggggtgtgggggatggggcatggaaagggcgtgtggggtgcaggggatggggcatggaggtgtgggggatggggtgtgtggggtgtcggggatggggcatgtggggtgtgggggatggggcatggaaagggcgtgtggggtgcagaggatggggcatgggggggtggggatggcgagtggggctggggcctgggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccgtggaagccggggcctcacagaggtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacacctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttgttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacacccatattagtgtccatggagtggccgtggcagagacgtccagccggacagaccagctgacccgccaagcccagcatggttagtgtcaggacctctgctgaagatgcttgctgaccctggccagaccccggttcctaatgccccctaaacgggacgggagccagtggcgggccctgatccaggtcagagctggctctgctttctcttttgtccgagtgaccatgcctcagtttcctcatgtgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccactctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatgagcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgccgtgggaggccagcctggcgttggcatccagcatcatcagtttgtgcagtcgggtggggctcagtgagtgcctcctgtgtgccaggcacaatgacgcacaatgtgtgcacaccaggctcatgtgcaggtggctgcgagacagggcgacccatcaaggcagatgcaccatgaggcagtggccagtgctgtgggtgttaggggcattgctccccggccactacggcatagcaggcagtgatcgccacactggccaagctttagaccatttattccagagaccccagaggcaaaaagcccggctgcacctcccagtgactcccacagccattgagcagagacactcaggaccttgtgatgggaggtttctgcactggagaacgagcccagaagccctctcagcctcggaacagtgtggccagtggtgggcaggtcaggaggggcttcagacacagcctgtccctccagatggtcacgggaaggtcactccccacagaagtacgttttggggccatgcgggcacagaaggtttgggggtgggtggggcaggtgccagcctggcctgtgggaggccatggtgcagatgccaagccccccccgtgacatgagaccacctgataccacccagagagtggctgtgagcggaagggcccgcccagaaacaagcagggccttggggcagaagtcctgggctcagatcccacgctcactgccagcggcctcggctcaggcttctgcgctctctaaacttagttttctcttctggaaaaatgatggggaaaatgatatttgtatgtgaggactgagagttaaatgtaaacatctggaaactacaaaatgagcacgaaatgatgtttttattcttagaacagaaagtccccacacccgcggccctggtgactgatgaggatgaggttctgcggggcctctctggccgcccagctctgcctggggaaggtggggcca

SEQ ID NO: 9 - DNA, 3278 bp, Homo sapiens
aggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtg

SEQ ID NO: 10 - DNA, 162001 bp, Homo sapiens
aggctgttgcgtatgtgagtctggagttcggaagagacatccaagttgctgacataaatttcggtcttcagtgtagaaatttgatttaaagccattgggttaaacaaaccaaccaaggtaagagtatttgcaggtaagagaagagacccaaggacttagccctaaggcactccagcattatgatgtaggggagatgaggaaccagcaaaggaggctgaatggaaacagagaaggaatggcgagttctgtgcaagagacaggaagaaagagaatgcaaaatggtcaaacaataaataattaagttgaattagatggtaaagaaataaatgcaaggaaatgcaaggccatagtcactgggcagacagagtaaaagaacatgatgaatcaggtgagattaatcacccctcctggaactatcagaaaaagatactcactgacagtgaggcagtcatgttagtccccaagttgatgactaatggaaactaaggtcacagtgcacattaatttcttttgaagcaaaggataaaaacaaacaaaatataaaagattaagatgtaaacgttagtgtacactaattcagagaagaattaaatgatttttaaaacttcaagaaggaggacagcattctaaatgcattgttctaaaacgatagtaagatgggataaatagtcacactagggtgatgattttggatgtgttaaatttgtcactttgagaccagatatgctccatttcacttcatgccagcttttaagaacatatatcatagaaaaagagaaaagaaacagttgaatcaaagtgaagagaaatattgtgaagcaaataaatccagggaaaaattaataaaaccctattcccaccctaaaaaaaagaaactaaaagaagtgcaaatataaagttcaataggagtcattagagattgtaaattgggctctgagcttcctaccaacaaaagcacaaaggaaaatatgatcactggtattaaaaaaaaacacctatggtttccaaaagattaaaacaaaccagcagttttatagaagctaacactaaaatctaaaggaactacgttctatggagccacttaatatggataaacactttgacaatattctttcaacaactacagtaacaagtttcttagagtccatttctttttacatccataatgaattgtaaatcttttctacttcttaagtaaaacatcaccacttaattctggtaacttttccatattaactttttagaacaattgcaaacgtaccataaatgattgttgtcacagtggtaactatttgaccctgactgttattttgtatatagcagcttttaaaataaaaaggcaacaagtttctaggcgtaatttccacagatcttttatgtaaaacaatgacatcctttgcaacttctgccatttaatctatctcaagcaagctctctggaaacaaatctatttgaaagattctattgtaattagaaatcagggtaactgaatgcactagatgaaaaccttctgactggggccaatgaagtcaataaagtcaaaactgctgtgaatgctcaactgtctgcagatcagatgtcttgggatggaatccgttctcgaggccaccatcattaatatcaatttggccatgtaatacaagcctcacttgttccactgttacaaatgtgcttaaaactgagctcatttacaatccaaatacatatgtaggatggtaaccaaggcatcacactaatttaggtattatgttttagggggaacaaaaggtatgttaatattttattcatctccaaattaactataaattgtgcattcttgcatagatcctccttgggaatgagaaattaggaaaatccagttgttaaaatgaatgcctaaaatcaaaataaaatttgtttttctggcacctgcttgatgacacagactaataaccaatgacaaaattgcccttgaacccaagttttcatttcctcctattgtgtggtcaggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagagggtaagagaagaaaaaagggaaagtggtgaaggcagggaggaaaattgcttagtgtgaatatgcacgcattcatttagttttcaaatccttgttgagcatgataaaattcccagcatcagacctcacatgttggtttccattaggatctgcctgggggaatatctgctgaatcagtggctctgagctgaactaggaaattcaccataattaggagagtcactgtatttctctccaaaaaaaaaaaagttatacccgagagacaggatcttctgatctgaaattttcttcacttctgaaattctctggtttgtgctcatcgttggtagctatttgttcatcaagagttgtgtagctggcttcttctgaaaaaaggaatctgcgtcatatctaagtcagatttcattctggtgctctcagagcagttagcccaggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaaggtaggttatatttttattcccattctatagctgggtaaagtgagttctaacaaagttacttgttaaaggtcactcagaggtcagagcatcagaaaaaaagacaatcacaaggctgatgttgtgtgctggatagtttaaactgaacaggaagaaaacatttttgtgggctttatctaaaaagaaatagtttgctctgagtttctcagtttcatttattcagcaagtatgtgccaagtgctattgtaggcaatgaagatacagcagggaacaaaacaaaactgacatggagcttccaactagaaaggagaacgagacaacgcgttttaaaatatatataatgtgttaggtaaaaagtgctataaggagagctaaaacacaatgagaggctagaagagtgatagtggcggaggggcttctctgaggagatgacatttgatcaggggtctgaataaagtaaagaggccagttatgtgaatatctggaagactcaaggggcagggcggaaatagccagtagaaaggccctgaggtaggaaggtgtgtggcaagtttgaggaaaaggaaagacagtctgactggagcaaagagaactggagctgaggccatcaaggcagccaggagccaggtgcagactgggctttgactctgcctgcagggaggaactgctgaaggttccaagcaaaggaccgccctgacctgccttaggtttgaacaggatccctctggctggtgtgtgaagaattaactgtagatgggcaagtgtggaaggaaggagagcagtcaggaagctgccataaccatctacatgagagaggtaaggcctcagatggaggggagcagtggaatggtggaaagtgtttattttgaatgttaagcctgcaggagttgctggaggattggacatgggggatgagaaaaagagagaggcttacagatcaggtaatttagctgatcttaagccccttacagcttaatattattccaaggtgccaataacagccaaggtaaacaaccttgtcttggacattctgcctttatttgcccacacaagatgaaattaaatatatatatatatatataatttaaataaataaattatatatatatataatttaaataaataaattatatatatatatatttagtgctgtttccatcagctactagctgagacacttgggcaaatgagggtgatctccagtcctcagtatccttgctgttaatgagagatggtcatttcttctctgcctagctcaaaagaatatgttaaataaaactctgtgaactttaggcagcacaggcttagggcttcttagtaacatcatcagcaccatcagagttaacttcatgagtcagttgagttgcctttggggtatatcattaacagattccaggaagctcccctgcccaaaagcctcccaccaatggcctgccttgttgaaagaattacacaattagcccaattcctttccattaaggcattgtggactccaaacatcctcctttaaaatggaaactaaatcgagctactgtcagtcatttgtccttttaggtgacgttatatatcagatcacttttctgccattagagctagttgaagtttgaatagggaaaaggaacgaatgaacgtggggcagagaacgcaatagtcggtgggttactcagtaggctgtggacagatggagaggatcccggtgggaggagcctctaaagataaactttctatgggaaaatgttgacagatttacctgagtcatggtttttcttacacctcataaaaatgaaggcttccaagggcagctccttgaaatagctgtaacaagtagccacagaagttgagttgcttaaagaaaaacattgaattcatggggaaccgtacgctttaatagcccctttggcttactttgtttaaacaaactcatcccgagcatctcacacttcaccaattttgagtgtccctgctttacctcagccttttaaagagtgtctttcccctaaatatttctggaaatgcctaagggtgctgacgtgcagccagaaatagttcacttctgtccccactatggcaggaatccatggaccaaggctctgatgtttccacaaagatgcccctcaggactagaaatctgtccccatccccgttgccaccacagtcaccatcacctggaaatcctgcaggaccaatgtttgtgaatttggaatatatgctagatgccttactaccttgttatgaccttatttctttatagcacttttaacctagcgcattacatattttaaatgtataattcagcgatccagatcactggtccagtgtcacctcccactcagcaaagtgagatgaacacacttggtgctacattcagctaggctggcactgtagatgcacccagtcccaggtattctagtggctcatgacagggcttcctcactggagacatgctgagccaagcaaggcagtttttaccaccaaccctgatagtcgtacacatattctgctcctccacccccaccaaggttgaaactccgctcctgtcagctttgcagctaccaccaccccctcagggagagtcatctctgttcccaaacccatataaatgtcattcaaagccagaggatgtaattgctgtagtaattgttatagtccactcatccaggggccccactgcaaagctgattaaaccatagtgttactaccttttacagagttattattcttccaaatcaacccactgcacctttctccaaggctacaaaagtgcccctagggtggctgtgtacaggcaagttttgatgtcagctgggaaactacctataacccccactctctgctaacaccaacttttctttttctattttattttattttattttactttaagttctgggatacatgtgcagaacgtgccggtttgttacacaggtatgcatgtgccatggtggcttgctgcacctatcaacccaccacctaggttttaagcctcgcatgcattaggtatttgtcctgatgctctccctccccttaccccccaccccctgacaggcccgggtatgtgatgttcccctccctgtgtccacatgttctcattgttcaactcccacttatgagtgagaacatgcataacaccaatttttcttattggaattgtagtgccagtttagttcttcagtggaagcacttgttcttctctataatctgttctccatctgggaacaccctactttctcagacataggtttgcagtgcattggtgggcaggatttcagtcctttctctgaaagttcctaagccctattgaaaaatgaatgcactggggaagggtgtggcccatctctctccccagaagctcctgagccacatttcttacccagtcccggaaccctggtatcctaaaccatgtctgaacctgtacccctgtggccccagaaagggaccaaacagtacatcccatgaaaccacaaagagatcataaccttctcctctctcctcccacatctctacataaacaacatttatatagatgactgaattcaagatacgtttatttggtactgatggtcaactggaagttcctaagcagaattacttataatgtgggactgtgtttttagtggttgcagtgaaggctcaacacccctaaacacggtgggaacttgctgaggaggcaggctgtgaagggcagggtattagcatctttccttaaaataacatgtgtcttagtgtgctcaggatgctacagtaaaaataccatagatttggtggcttaaacaacaaacatttatttctcacagtctggaggctgtgaagtccaagatcaaggcactgacagatccagtgtctggtaaaggcctgcatcctagttcatagcccgctgtcttctcactgtcctcaagaggctgaaagggtgagagagctcttccgagactctttcataagggcactaatcccattcatagggctccaccttcatgacctaattacttacaaaggccctacctcctaataccatcatattgggggttaggatttcaacgtatgaattttggggagacacaaacattcagtctatataacaacacgtaccgtgaaactttcctactcataaaagtaatatatcttcactggagaaagtaaaaaagtacagaaaaatatgtagaagaaaatctaccatcatctcacatccagagatatccatggtaaatattttaatacaattcctgtgaagttattcagtacacattaatagagtttgaaaacataatctaatataaaagcatgaaattcataaagatattttaaaataaagttaatatgtatgtgtgtatatgtatttttatatatacacaaacatatatgcttattatttttattgtgagcattcccccatattattagaaaaccatgattttttgttctttttctttttcttttcttttcttttttttttttggagatggagtctcactctctcacccaggctggagtgcagtggtgcaatcttggcttactgcaacctccacctcccaggctcaagcaattctcctgcctcagcctcccgagtaacagggattacaggcccctgccaccatgcccatctaatttttttgtatttttagtagagatggggtttcaccatgttggccaggctggtcttgaactcctgacctcaggtgatctgcccacctcggcctcccaaagtgctggaattacaggcataagccaccgcaccagaccaaaaaccatgatttttgatggcatcatcttatggatgcaatataattaatttaaccattcttctactagttaatattaaggtcatttccaacttttattgttgttacattgcctctcattttctttataaatatttggctctttttattttggatatgttgtagctaaaatgccatccagatagtttattctgatttagtgcccaccaggttctaggtgcatgactgccatagcagagatagttgcatacagttcaagtttagattttgtttgtgagcgggagaatccaaagaccaagttcctaatattcttttgcctgaaaaatggctacataaccttgccaaatctcttaacattttcatgcctttgtttctaatatggaaaatgaagatactcaccaatttgtaactgtaaactactacacaagaatgaggtattcatttaaccatatggtgagattttgtagttaaaattaattaattgtgctcagtggtcagactactggctttaaatcctggatccattattcattacttcctattgtgtaacctgggcaagttacttaacttctcttctccttagtttcctcatctataaaatgaataacagaagcacttaccataagtgaggatgagataagatggtggtatatgtgagtggtacacatctgttactattattatcattgttatttattattaagcagtgaatttagactcaatgtgaaatggtttagaagtcatcagcttcccgtttcatgttcttaaagcactggtgataagagtatgcctgtatcatgcagttataactttaatcaaaatatgaaagtaactttaatcaaaatgccaagtcaaattagcaaagtcagcccttttcaaaatgtgtgccctaaagtaataaggtctgcagggtgtgccccagggacctttggtggggagtgggtggtagtcagaatggcgaaaacagtggggatttttagggcccccactcacattgctttgcttttatagcaaaaattgttggctgatgaacaaaatcatttccttttcttggactcacagctagacctaacttcccaagtcctgtacagttaaatgttaccatacaattacagtggagccatatgtgtctgtctcaaccacccaagcctgccattgcagtgtgaaagcagccataggcaatacttaaacaaagggatgtgctgtgttccaataaaatgttaccaaactttcctatagtttgccagcccctgaactagagcatggtaaggcaagagagaattgtagaacgtggttggaaaggcagaaggagtcagggaggaaagaccttgtggaactctagcacaaagtttggattttatcctaaaagcagaagggaagcctttgaagggttttagaaaagggtatgacctgaattacagaagctcagtcctcagcagatcagtatttcaacattcactcaccatgtgaaccattgatcccattttgttacttcctctgtagaatctcctcttaaggaaattgaaagcaagctcctgaatgagatggcattttcagggaaagaccaggaggcagaccccaaggggcttcacaagatggcatttttgtggccttggtggatttgccatgaccttggcttggcaggatcagaaacctgaatctattcgcctgtaagtcctcttttcttgtaagtcctataagacttacactaagttcaggtgattaacatattaagtcaaaaagcccattttagtaatttttaatgaaaaacataattgccacatgtgagaagcccattctattttcatagacatacttatattagaataacaatgaccataatggttagcatttattaacaataacattgtgccaggcacagtgtcaagcattttccatgatgacctcacaagtctatcggtaggaattgtggttaaaaccctcttatagataaagtcagaggttctaaacttataagatcacaatgctagtgagtggtagagatgagatttgaacccacacagtgtaaaccagagtgtggatacctagccactacaacatagtgtctcataggagacatgttcagaaggttgctagtggacattgaatccatgggggaaaagaaggcagaaaaatctgattttaatgttatcaggttaatggggcctgatgcagccatcttgcagaagaacggtattgctagcaggtcctccatgtttgtttacaacactggctacggccttcccactaggatgggaattcccaaatcctataatttcctagatggtgctggaagaggcactgctgaggtttgttttgccaactatctttcccctcttcttcttgccttatttgtcattctatccattaaggtgacttttcatccattttatatgaatttcataattaacctctcagggtaattcccccagcccaccctactatcagggcagtccccaatatgactaatcattcccacatactaagaccacagactgcttcagaatctgtatttatattttcactattaaaaaactatgctatcgtttcctgaaatctctatgaaaaaaaaatactaagctatatctggagtgaaatggtcagtaagaacacagtttgtcacacaaaataatgaaaatgctatttcttacttatagtgcagactggggttcttcctctagaattagaaatattaggcttgctaagatgtgatggggagttcattggggctagtgttttagcttttgaactcttcaaaaggaacagaaatgaagaaaaagacctgctttaataaacaaggttaagtctgtatgatttatggacttatgagcaaatctgacatccactcacatgggtggtcctcccaagggataaacttcgtaaaagcacatttaagaaaaagggagcagatactgttggtgccctcttcaccaggagacacactgaaaggctgcagtagcacatcagagcctcacaggtcagcatcagccaaacagctgttctgtgcatcacaagaattcgtacatatttcaaaatgactaatttgtacctatgagacaggatttgacccactaatttttgtaccgtaacgttttaataaaaattgttttttcaaagcgaagctttgctgagcagatgaattatcatgtgggagtttaaaaattagtcaaaggagtcttgacaactaagtcctttaagcttggccttcccttggcctctgcctactcctgatcataatctgaataaactttaacttttcgactagaatgcaaaacacgtgtttttgtaaaacgaatattaatggcataactcgtgctttattattttagctgatttgtatcaatgtatcaacattccaaagaaaatagggagcatatgttggttaataatttttgttatgactattgacatgtaattcacatgacataaactttaccattttaaaaagtacaattcagtgagtttgagtatgttcttaattttgtacaaccatccccgctatcaaatttcaaagcatatccatcacaccaacaataaactctggttctattagtagtcactcccaattcccttttccctagccccctggcgaccactaattaattatttctctgtctctatggatttgcctaccatgaacattgcatataaatggaatcacacaatatgtagtcttttgtgtctggcaccttccactcaacatactgtattaaaggtttctccatgttatagcatgcatcgatccacacttcatttcctgttatggctgaataacattttgtcctctgaatctaccatatttgtttatccactcatgagctgatcacttaggctgttgccacttattagctattatgaataatgttgttatgaacgttcatgtacaagtttttgggcagacatgttatttctcctgggtaaattcctaggagttgaattgctgggtcatatagtaactctatgtttacctttttgagaaaactgccaatatgttttccacagtgtctgaaccattttataatttcgctggcaatgtatgagagttccactttctccacatcttcaccaacatttattttcctttttttaaaaaacaattattgctgtcctagtgggtatgaagtgatatctcctgtattttcaatttgcatttctgtaatgaataatgatattgtgcatcttttatgtgcttattggctagttgcacatcttctttagagaactatcaggtcatttgcctttttttgaaatgttggttgtctttttattgttgaaatataaaagttctttatatattctagatctagacctttactggatatatgacttgcaaattctaccatttctgtacgttgtctacaatttcaaccattctgtgggttgtctttttattttcttcacaacgtcttttgaagcagaatagtttttcattgtgatgaagtccagtttgactatttttttcttgtgcttttggtattgtaactaacaaaccattgactaatccgagattctgatgtacatacatgctttcttctaagttttataattttagcttttacatttaagtttttaatccattttgagttaattttttaaatattcttttgcatgtagctatccagttgtcccaatgctatttgttgaataggtgattctttcctcattgaatggtcttggtattcttgtaaaaaatcagttgactgtaggcatatgggtttctggactctcaattctacccgactgatctgaatgcctatcctcatgccagtactacactgtcttgattactgcagctttgtagtatgtaagtagtagtacgttttgtgagtcctcgaactttgcctttttttatagattgttttgctattttgagttaagtatttttttaaaacatcaagttaaaaatgaagctgccactctctaaaggaggacaatttcagaaaggcactgagacctgtgcttggtatgtagtaggtgcttttgaaaatgtttgttgcatggaatggattgatttcatctctattctaacactcaatgccatgttcatttcccctttggagcctttcatctctcccttctcttttctaagaaaatcagtaactctctcattcatacattgtacacatacatatctttatttgtttatgtgtctattttccactaattagactataatgccatataaggctagaattacatctaattcattgctgggtcccaaagccatgcttaagaccataagtatataggggttttttttcttttaaaaagtttttatttttaattattatggatacataagagttacagatatgtaaagggtacatgtgacattttgatacaagcatacaccatataatgatcaaatcagggtaactgggatatccgtcacctcaagcatttgtaatgtatttgtgttagaagcattgcaattccactcttagttattttgaaatatacaataaatttttgttaactgtagtcaccctgttgtctactgaacactagatcttattcctcatatctgactgcattttcgtatccattaaacacccctcttttttattttttattttatttattattattatactataagttttagggtacatgtgcacaatgtgcaggttagttacatatgtatacatgtgccatggtggtgcgctgcacccattaactcgtcatctagcattaggtatatctcccaatgctatccctcccccctccccacaccccacaacagtccccagagtgtgatgttccccttcctgtgtccatgtgttctcattgttcaattcccacctacgagtgagaatatgcggttaaacaccccctctttatcccccctccccactacccttcccagaccctagtaaccatcattctattctttctctctctgagttcccacatatgagcaagaaatgtgatatttgtctttctgtgcctggcttatttctcttgcataatgtcctccagttccatccatgttgatgaaagagacataatttcattcttttttatggctgaataacatttcattgtgtatatgtacaacattttctttattcatctgttggtggacacttaggttgattccataccttggctattgtgaatagtgctgcggtaaacatgggagtgcagatatctcttcgatatactgattttctttcttttgggtatatgtccagcagtgggattgctgggtaatatggtagctctattttgttgttgttgttgtttttaggaaccttcatactgttctccatagtggctgtactaatttacgttcccaccaacagtgtatgagggttcccctttctccacacttttgagagcatccgtaattccctgtctttttgatagaagcaattttcactgggatgagatgatatctcattgtagtttagacttatatttctctgatgattaaggatgttgagtatttttggccattcgtatgtcatctattcagatcttttgaccatttttaaatcaaattattttttcctattgagttgtttacacaacttatatattctgtttattaatcccttatcagataggtagcttccagatattttattccattctgtgagttgtctcttcactttgttgatggtttcctttgctgtgcagaagccttttagcttgaggtgatctcatttgtccacttttgcactggttgactgtgcttttgatgtcttattcaaaaaatatttggccagaccaatgtcatctcttgccatatacaaaaatcaaatcaaattggattaaaaacctaaatcgaaggcctgcaagtatgaaaccactagaataaaacaatatatatgtgttggagggagagaagaaagtaatgaagaaagaaaggccaggtgagaaagtaagagagaagggaaaatgaacaagaaagacaaaagtcattccaggcactgttttaaggggcatctcatttattcttacaaccttatgagataagcactcttactttcagtttgttcaggatgctataacagaatcccatagactgcgtgggttataaacaatagaaatttatttctcttagttctagtgactgggaagtccatgatcaaggcactgacagaactgttatctggtgaggacctgcttcctggtttacaaatggacagccatcttctcttcttgctttgtcctcacatggtgggaaggggtaaagaagctccctgaggcctcttttatatgggcactaatcccattcatgagggctctgccctcatgaccaaatcacctcccaaaggttccacctcctaatgccatcaccatggggttaggatttcaacaggaatttggaaaggacacagacattcagaacatagcacccccattttacagataagaacagtgagaaacagagagttaaataattttctcaaggtcatacaacgaacccgtagcctaggcagcctggctctttggtcatgttcttaaatactatgccatactgtctctcaaataaacactaaaatcaagatacttgggatgatcgttgggaggcagagcccagatatctatactttaaacaaattcccaaatgatctgatgggcaactcagatgaaaatcaatgcttcaagaaatagccaaataaaactctatggaaggtaaagatggggagagcttggtgagatgtcatacttgggaggaaaagccagggaaagtaagagaaaactgggtattagtaaagatcatggagaagggaaaacacaagatattgctaggctaaaaaagaggcagacctgatgaagcagtgaacaccacttcagccactccctaccttggccccagctggccctggctgtgactgtgttccatactctgcaatgacatgtaacttccaccacgtccatatcatacctaaagcctacttcagtgtgtccacaaaagcaagtaagaataaaaagtaagagaaacaactcacatttatttgctgcttattatgtgccaggctatgtccttttttttttgagatagagtctcactctgtcacccaggctggagtgcagtggtgtgagcttggctcactgcaacttctgcctcctggggtcaagtgattctcctgcctcagcctcccaagtggctgaaattacaggcacgtttagtagagatggggttttgctatgttggccaggctgatcttcaattccagacctcaagtgatgtgcccacctcagcctcacaaagtgctgggattacaggtgtgagcctccacacccatgtgccaggctatgttttaagtgctctacccatgagaactcacttagtcctcataacaatcctgtgaggtaggtactattgtttccccccattttacagggaaggactctgaagcacacagaggttaaggagtttatcaaggtcactgtagctaacaagcagcagaaccagattcaaacccggagcccacactcttaatcactatgttgcttctagaagaaagaaaataagggatgaaggatagtaaaaacatgcaagcccttctgagccccctgttgttggccccactttggcaggagtgttaggaagactatgggaactcaaaggtgacacttagcactctcctccagaggctacaggagccatcattggtagctagccatttgtatcccccgtgatggtggagaaaagcccacactgttgcaagtttccagaattttctctgctctggaaaagactcccaaactagggttaatcaagtatcttttttggtgaatttcattaaaattaccacataaaaaaagaagaatttgtcctgaattatacatataggagaaaaatgataaaataaaataatttccattatctttgtagcaaaaaaagttggaatgattccaccaggttctctgaaggactttgttttcaaaggagatgttaaaatgtgtaaaatatccaaaggatacacttttgcagctgaatttaggatcttaagaaacatggttttaccgtgtttcccaatgattgttgaaaagaagcagtgactgggttacatctagggcagggtttctcagcctcggcactattgacattttgggccgggtaattctttgttgtggggggctgtgctatgcattgcaggatgtttagcaggatccctggcttctacccactagatgccaataagattctccctttccatctgtgacaaccaaaaatgtctccaggaatttccaaatatcccctagggccaaaatcacccagttgaaaactagtgttctagggaaaaccattataattaatagcatgtctatgatctcccctgttgcgggaagtcagggaccccaaacggagggaccagctgaagccatggcagaagaacgtggattgtgaagatttcatggacatttattagttccccaaattaatacttctataatttcctatgcctgtcttcactgcaatctctaaacacaaattgtgaagatttcatggacacttatcacttccccaatcaatacccttgtgatttcctatacctgtctttactttaatctcttaatcctgtcatctcctaaactgaggaggatgtatgttgcctcaggaccctgtgataattgtgttaactgcacaaattgtagagcatgtgtgtttgaacaatatgaaatctgggcaccttgaaaaaagaacaggataacagcaattgttcaggtaataagagagataaccttaaactctgaccgccggtgagccagggggaacagagccatatttctcttctttcaaaagcaaatgggagaaatattgctgaattctttttctcagcaaggaacatccctgagaaagagaatatgcccctgagggtgggtctctgaaatggcccccttgggtgtggctgtcttctatggttgaaactgtagggatgaaataaaccccagtctcccatagcgctcccaggcttattaggaagaggaaattcctgcctaatatattttggtcagaccagttgctctcaaaccctgtctcctgataagatgttatcaaagacaatggtgcccaaaactttgttagcaattttaatttcgcccccgtcctgtggtcctgtgatttcgccctgcctccatttgccttgtgatattctattaccttgtgaagcgcgtgatctctgtgacccacacctattcgtacattccctccccttttgaaagtccctaataaaaacttgctggttttgcggcttgtggggcatcacggaacctaccaacatgtgatgtctcccccagacgcccagctttaaaatttctctcttttgaactctgtccctttatttctcaaactggctgacgcttagggaaaatagaaaagaacctatgtgactatcggggcaggttccccgatactccccaaagtattgcatggaatgccacatttcttttatcatagtgcttcaaataagtatttcagtgtgttactgaaaatatttataaacaaaatatatttgatagcagggtatgaatatgcccgtgtccttggaagagaaagaggggacaagagaacaggtataacagcatgttgttggtgaaaataaattggtagtaatatagattgaatatcccttatccaaaatgcttccgacaggaagggttttggatttcagatattttcagattttgaaatatttgcagaatacatacaggtagagcatccctaatccaaaaatccaaaatctgaaatgttccaatgagcatttcctttgagcatcatgatagcactcaaaaagctttggattttggagcatttccgatttcagaatttgggattagggatatttgacctatagtaatgccaaatactgcactaaaattagcaaatgtaatctcattgaattgtgacaacagccttaagaggaaacccgatcattatgcctacttagtagatgaggaaacagaggtaactaggtcaaggtcacacaacttggagtgtcagagtctggattctttctagttctgccctcgtccaagccagttctgttaacactattcttcctttcagcataatctgtgtcatcactggagcttatgtctacctgcctgccacccagcaccaactgtttaccctttaagtctcattctgcctcctccaggagccttccctgacccctgccttcaccttctgacctgtgccccttcacaccctgtgccctcttaactgggaaagccctgagggcaggggccataccttatttacctctatctccagctcactgcacagaggcattcagcagatgaccagtaaatatgggctgtctagtaaaaactttgcagttagagataatgaaagaaacataattacttctgtgtgggttgagaaagaagggaagggaaagtccagatacttaagcagaaaaaggcaaacagtccaaaaggggaaaagtaacttgcccaaatcatgcagttgagggcaggaagaaagggggacaaagccaaaaccaaaacccagtcccttgtcccagcccagtgctttgtctgctacgttacacaaactgtgattgtgaaattaaagggtttttgatggcactgatataagtaaataaatggctttatgagttaacacatgacaagcaataaactcataaaaggtaaatattgacaactgaagattatatatcactatgtttagtgtgtggagaacccaactaggaattaggaaagcttgcacattcagtctggtttcttggcaaatcaatgagacttcaaacaaatcattttatttctctgtgcttctgtttcttttggctgtagtattttgctggttaaagagcacgtgatcaatgtctatgcttttaaatgtctgtctttatttgagcatgctcagctggatgtggaaaacctatggttctcttgggtttcataaggatcaaatcccacagtgatatgtaaacttgtgtggtttatagaattataggacctcaaagctgggagaggcctgataaatcatatagtgaaaatttccagccagtgcctggatttcttttacagaatctttcttttattggacaggtgctcccttcacaatccatgatgtaaggagaaaaggggcttcgtttgaaggaagttagtgtattgtgtatgggcgtgtactttctgcttggggtgtgcctacagggctatctcactttctgaaagcgtaataataagttactttaccatgcattaattaaatgtcagagaccatgctaaatgctttacagagaatatcttttttaatctgtataagaacctcctgaggcagataatattattaaccttacttttcagataaggaaactaacattcagaaaagttaagtaacttgctaaagacatgtgtctactaggaggtagagtctcaagtctatttcaagctcctaataagtaaataaatgtctattgaatccaactaatgacatcccactccatattcccctgccactgatgagagagagaagtataaagtttatgtaaataagacagaagcaatgttttatataagcattgtggatttaattccactaagggattgatttttcatcttaatggaactttttcttcagctatcaagtttcagtttcaagatcgcaaatgctaagaagatattaaaatattttaatacataattccactagatcatatttataggtactgttaatatattaccaaatctactataaacaaaacaataaaacaaaaggctggatcaatatggaaagtagagtaataatttaggccctaaagaaaaactacgtaagacatttcttagaggattaccaggtttctctctctctctctttttaaacacagcctaaaatagaaaagcaatttatgtattaataaaaaaaatagaaacctgaggcagatgtaaccagaataggtgaattaactgaagactgatattcttatttatgtttgtgtattttaaataaagaaggagtttgaccatctcatctagttaatcattaaaaggaaactcgagccaaacttgtgaagcaggtaaagtttatttttagacattcaactggcttctcttttgggctccccttttcttttggggtcatcctccatgtctggtaaccttaacctccctgtctcttccagaaggagcaacacccccatgttttagacctttacttctgatgtcaggaccctttctgatgcaagtgttagctaactccagctggctgaagaggaaggaggaggaagagaaggagggggaataatgtattgaagtgtgtaatagtcaagtctaggagcagccctcaccttaggatctagacattcatattatataattgggaatctatttccagatctctttgctttttttttttgcaaacctcaatccaatggagtctctaagtggtagaccacagctgctccaagcttgcatcgtatcagcttagctattcctgttgagaaacaagacaagtttccaagtagtcccagaaagccaagaattaaggtgtatctgtccctgtcatgtgcctatctctgatattaccagacctggcccatgcagagttacagatgggttaataccaccataagcgcatggaccaaagttagggaaaggatagttttccaaaggaaatgttaggtcctagtatcatatgtggagaggggatacttggcaagtaaaacagtacctatctaccatgtggccacaacagggcagatcagggtccctggtaggatggaggcagccatcaagcattatggtatccctgaataatcccttcccagttcatatgtaaaccaatcctcttaaattgttaatgcatttaacataaggatggattcagcaaaactgtatcaatagcaaaacatgaggggtctccagctagtagcctgtcctgcatagccatccatgactactgctctaattgattttttctagaatgtctaaaggaagatgaaagtagaaaatgagctgtagtggacaagcatttttaaaatgagcccaataatgtagcacttttgggtgcttgataattgttgcaaatcacatttgcctgagaaatttcaattctataataattgtacaatagcagaaagatctagatacaaaaatattcattgcagcatggcttgcaatagtgaaaaattgaaaacaatttacatatacttcaataaggaaaggttaaaacaatggtatactatgctactattacctgaaaatattgaaaagatgaaaagatgtccaataacatttgatgaataaaggttgaaaaatacatgtagtaaaatctcatttttgtttttaaaaaacatatatgcatgcatgcatccatgtatagacaaaaaggatttgaaaatatacaataaattatagttaatcacatttaccttatggtactgcagaacatcagaactcattcctcttatctagctgtaattttgtaatcgttaactaatctctccccatcctccccttccccctgcccttcccagcctctgatagtcacaattctactttctatttcacataataaaagtttttaaagaggggaataatggggtgggggatctggaatatacataaaaactcaaaaataattacaaatttgttgccatcaaaatataaaaagaaaaaaatagttacatctgcaaaatgggattgtgtgaggaagtttttacctttatacatttctaccttctgtatgtttggatttttacaataagtatgtgttattttctagcatcttttgaagtttttttcttaaaggcataagtaatatctaaagttatttttcatccttctaatgccgtctacacaaagataacgatttttcttggatggccccaatctctcttctgtaagatctttccccatttgtcatatccataactcataacctcctcacccttcactgctctccattttctctataaagtgagcccagtcagtacttgtaggcttgttaagcattacttctaataagaaagactaacttgtaaagcaaatgtggaaatgtactaatatagcatcaagcacaaaatagccattcaataaccgaactatttaattccttttttttcacacttcatcctttccctaattccagaaagaacttgaactgggtcataacaaagacaaatttagacagacagataaagatatctcataggtagaaataaaactgagtgattataaactaatcacaggaggctctgttagtctgatgaacagaaacacacgtgataaaatcacagagaggtaaaatagaaaatgaaaatcaggatcaagaaaagggaaataaaaatatgctggacatcattcaataactatttgctgatggtaattatagggatggaaaacccatcaggcctatggagctaaaattaatcagcaagtattcacagagtgcctactgcttctattactggttctggcttcctgcctgcccagtgcagaggcttgagacatttgcgtgacattcagcttgtcaagacagaaggagcaaaataagcagacagaggctcactgcagccgcctatacccatcatattgttggaatcatattcaagtgagacaaactccttcagtggaagacgataaaactagcttaaaagttgtaaacatcacttcatcacccaaaaaaggcccaattaagtggagatactatttctgcaaagcaatcatcaattcatttgtgtaacatttgaaatttcaaagtacaaacccacattctattaaaggcaggaagtgaaaccaataaaacttgtaacaactatacttaattttcagggttctttccattgctgacaaacattttaagtcatgtctattctcttaaaatgtaaaatatgatgtttatgtcactgttaatattttgataaaaagctattgtcatggacatctgggtttttttctgcatgcccagaaatcccttttctcctatttaaatttaaaatctccaattatttggagaagcacctcctcttctctctctttcatttgtaccccattcttaggtgtcagtggtgggcacttgagctaggctttgcccatcatagtacacattcctgacatcccttggtcatagttattggtccagggataagcatttgaaccaactagaccagtgaaacccctcccaggaacaactactaaaattatgggaaaagaactctttccactgaagttactaacctggcaggatgtgttaaatccaggtgccacaggccaccaggtggagaggtggagataatctttccagaaaacaaaacaaaacaaaacaggaaaatgaagctaagggataaaatttaagccctttggacttcatttgagcccctgaatccagtcatgcctcctgaaattaaacttcccctggacttttcagtgaatcaaaaaactctgtttttaacagtggggtttcttataaatgcaccaaaaaatgacctaatgaatgttgtctacaagcttccattagaagtattatcttcaagagaaaaaaaaaacaaataacttgaagaaaacccttcataattcaagtcagtcctgctaacctctaggaaaccctccgtgaccaccatctccatatccacacccattttcctaaccttaaacaccagatgacttcttgaagcttatgaagtgccctatgcatctaacacatttctgtaagtctgcattgttctataatgacttgtaaccgtatctgtctccatttcctccagagaagagattgttatcattttgatatccctgcagccttatactggggcctaacatataatagttgctattttgttgaaggaattgtattttgttgaaggaattctcttttgttgaaggaatgaatggagagaatattaattaagaaagtctcttctattaataaacattccctgattgattgaaaccatgcctaaaatagctaatcatcagaagaccaaagtaaacaacatatccaaactgaatcctcaaagtgttagtcattggtagctgtatagctgagaatctttccttcttctggtcattagggttgaaagggtgggtgaatgtggagacatgattctttcttttgcaaaacatttactattttttaaactccataaaatgtaataacttctcttgaaaaatgttaaaacccaaacaaaaaaacctgtaatgtggaatatagattgtaggttataatggaggaagcagggaaagtggggaaaactgtggttgccagaagttttctgataactaataggcaagacaatagggtggcttttggtagggtccttctttatggcatagcaaagaaaaataggaatgaagaagtgagaagcatgaaaggggacagcaatatatgtgtaacacagggtgattcagtgtgagagttttataattaaaattgccaaatgtgagaaaaaaaaatctactataaattgggataggctcaaggcatggagatgaacaaataacccctccatgtgggcaaaaatcaatgaaattactagatgagtagcttagtatgtgagttccagttgcaacatgttactggtatttggggcttcccctcccccctccccccctgcactttgaggcaattcgacatttgactaacaatccagcctaactttctccatctgatataaagatatttaccttgaaatcctagaactgccaacatctcctacttcctactacaaccctccctgactccttttctctggcacagctttctatgcactcaccccattcaactaagcctgcttactcttcaccagaaggtcttctcttagcataaaaagttcctggaagtccatctctttcatagagctgctggatgactgctttgcttacctttggccttcaaaatacctctcctgtccaaccatagctccccagctcccctgccattgcaaccaatacaaacttcgtcatctttccttgggccaatgtgcctgtctcctcactgctctccctgctttctcccttagcccctacaactcatactccacatcgcaagcagaacgagcttttcaaatagtaaattagattatgtccattagtgtgttagtaaatgtttaacagctcctgaggggaacagagtatctatgtgttttataatttttacatatatgtatcacataatttacaaaaagcaagaaaaaatataacactcttaatagtaaattctatatggccatgtgattttcacagaaccatttcagtgatttttgcagaatatttgtgtccatagccaacctacagctaaaattcaaacacgtttggcaaaatcagaccacaaataaatatctgattaatatccaatcagcaaagaagtcattcatggtactgaagtcccaacatgaatgttggttgatatttttacattaatgagcgagataaaagtgaagcaacaaaaatggatgttggaactaaactcgttcattaatgacagaagtgacttcttttgctgataatagctttcaagtactagaaaaatatttcctcaagtttttgtgttcacaaactaaggcacttttaagttcaatcttcattattaaaatttcttctactctgtcagtctagacaatcaacaaaacaaatcaagctctggtttgtcatgtttcccaatttctatagtataggtactccaccatggttgatttcaaactaccaaaataacatttctgaatgcagcgttaggaagggatacgctgcatcataccatcgtatggtatgttcttatacagaacagacagaaataactttaagaacatagataatagtaaaatggagtaaaataattaggcagtaaagtcttcagcatttatttttgttgttaaaatatttgattgtgagtttataaataatttggtttttaataatgactgtgattaacaaccaacttacaaaatctctgaaaatttaacagtcagtgcttgcaagctggtacaattgtttccggtgcactactgaattatcactcccctgcctaaaattccagactgcccattgcactgattccctgggaaataagtgaaaagagacaatgataattttcatttttgttgtggtgaagtgatagtgcaaaaattccataagctcctctaagttttccaaataaagcttagtgtttaaaaacgtttgaacacatgatcccatgtaaggcctacattacttcctgtgtgataggtggggtagatatcattatccttcctttacagattgaaaaacaaggctgagaaaaatcaaatgcctaccccaggctcattcaagtaagtaaatggcagaatagggtctaaaaaccaggtcttgtattgaaaattcaacaagaggatagagaaaatttaattgacaaatactgatctcaaaacaatttttttttcaatggtgacaaatgtcctttgtagcactttggagtttgatatgaagtatcttcttatcttgttaagggatccctataccaagaatgttttcatctcaaccccactatttctaagttagcttaaaaacaaaacaaaaccctgtgtgctctaataagaagatataagaaccaaaatggaaatgcaggttctcaaatgagctgaaagattccacatagcagcggggcagattgaaacactctttaccaaaggaacatgggagagaaaaggagattaaatcaagaaaggaagaaagctaatgacatatgaggagccacaaatgccacaaatgaaaaaacaaagtacgtaatacttgttgcaattattcagtgtgcttgctctaatgcctccaaacattaaaaacattgagttcctgcttatggcaacatttatctcatttatctgctgatagctgcctcatccttgaatcaggtattgcttaaactaagttctgccagcataaagaataaagtcaaccaggacacccattgggcatttcacgcatatgagcacaaattgtgatattttaggttgcttatgatgaaatcattgaaagcatcatgaaagacagcaaaacagcaggaaagctagtaataatttagcatttcccagtccaggcgggaatgttaattctaattacaacgaggaataccaaagtggagttcattatgattaagaacttgctgtactagtgtgaattgtttataataggcatgtctggcataaaatacaaatattgaagcagacagagatggctcattcaaagctcagctgggttcccttgaacctcttaccttataaagttaaataggaatagaagtattttccaaagtcaagatattattttaaagagacaaataatagctatgatagctgcaggaataattttttaaagtaagttctaaccaccaataaaagctgtttgtgtgggcttaacatgttcaaaatacacaatacacatgtacacaatacacgtatacatggttcccatttatatttaacatcacacatttaaagtgagagagtacagaaaaaaagaataaatggaaactgaagccatgacaaagaatcacggactataggaaaataagtcacaaagaagtatgcttatgtaagaggaaatatatgtgataaacaacaggagacatgggaatgaatgtggtgtcttatgtcctttctttaacagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatgatgaaatgagtgtaaaaaattgttctataaaatctaaatggaaagatgccctatagccttccttgacttacagttgcgtcaagtaaggtggatgtaagacaattttaaaagactggtgtgggggcaggagtgaggaatcataaaaatttagaaatctgcacgaaaattattctaaaagtacacattgaacatccctaacttgaaaatctgaattttgaagtgctccaaaatccaaaactttttgagcattgttatgataccacaaatgaaaaatcctacatggaagtacttaccacaaactttgcttcatgccccaaattattttaaatattgtataaaattatcttcaggctataaggtgtatatgaaacaaaaaatgaatttcctatttagacttgggtcccatggccgagatatctcattataatgcaaatattccaaaatcagaaaaaaaaaaatccaaaatctaaaacactttcagtattaagcatttcaggtcatggatactgaatgtgtatctttaatttcttgttctactttgtttaaaaaaaagggggaaaatagtaattctacagatgaataataattgctaatgatgagcaaatacttcctatgacccaggaattcgtctaagcacttcacatatatcaaactggtttaatctttataaatcagtactattattatccccattttacagatgatggaaaaaggcacagagagttagcctgcccaaggttacattccttttagtggtggagactgtatttggcctttatagtctggcttttaactgctacactatatcaatgcattacaggtatagtttatacacacactaaagaagacatggaactccagtcagtgggctcataaaagctttagaccttcatcaaaagattagaaaataaatgttcaatcacaggttttaggtttcaaaagtttcaaaagtttaaagtttgcaagttatctttcttaaaattatttccttcttttaactaatttttaaattaaactccagttcaatcacatccactagaaggcttcactttctacaaaggggtaggtaaaggtgatgatcttaaataccatactgggagttgggatctgtgtagcactagaatcaagagttattgtatatacttgagaaggagcacagcctgatttagttgatgttttggaggggtaatctggcagtacagcttggattattttagtgggaatggagatgacaaaacatgaagagaatgggagaactcacttgggtaatatatcagtttctgaaatcaatgtatcaagtggtttggttattagtcaggcttaaggttttattggccttaggacatagtctctaagaccatatattatcttcattcattcatttaaccaacacccactgagcaccaactatgcactagtgatacaggggtgaacaaacagacacagtccctgcctttgcagaacttatgttctggtgggtgatacagagaaataacaaatgagggcacaaataatgaactatcattgtaatgtgctaacaaagtatgcagaatactataagaacatacaatcaagaatctaatctagtttattttaaaaaaaagtggggggagcactcagatgtttaaacacaaaacaataaaaatgaggatcttgagggttatctgtacactttttattaacccatttggccacaacaataacccagtaaaagtgattttacatctagttaactagttgactcaatgttattataaccctgtaatgtatttgttgggtgcctgctatgtagtgggctgtgttccaggagtgggacataaagctatgacaagatagatcaggtccttgccttgactgagtctgaatacatcaccttcatttccacctctgcttctaagacaatcaaataccttcccactcagatagggattcatcctatttcttgtagtaattataagttcccagggttacagattagtaaatgccatacctaaagacttaggatactgtgcataaaacactttcaatagtgtctgtcagacagcagatgcgcaataaatgttgactttcgttagaattgtgttattattataatgctaaatctcacgtcctttctggcacactggagttcatctcttcaattaaattccgtaagcacatattgtaagtagtctatcagaattgatatactacttcatgttaatgattgagatcagtgaggaaaaccactttaatattgtctaattcctctcttaatgcataggagccatgtgaacttagacaagcatcaacctctgtaagcctgttgtcctcatattgaaaaatcgaataacaatacctatctcatttaattgttgtcagcaaaagtgggcagcagaagagtggggatcaataaatgttagccacaaatcataactatttgtattactctgaaaaagaggggttaacttatagttcatgcatgcttccaaatgaatgtgaaagactaaagaatgagaatttttttgctatcaaattaaaaaattaacaggcacatttagattgctgaagagagaaattaggataagtttttttttttttttgctcaattaaaaacgttttcaatggcatatttaaaactacgtattcttccccattaagatctgcagagaaaaaaaaatgaagggagaataattgggaactcttgtgaaatcataaattatttaagcagagtacctaccactaaggatttgagcatgtatgagcgatgaggtggattcttagagcagagattcagcagtgagacaggctaatggcatggggagatgtgttctattagacaactgtattgtccccttaattatatacatatatatgtatataatatatatgtgtatacatatgtatacatacatgtatatataaatagaattcttaatcattttaagcagtgtacaaggataattattagcatgggctatttaactcacttttaaaacgtgtaaaacattattgtagggttgggtcttgatttgtttcccatgaaactgttggtagtttaggggccaaattaacgaaagacatctcattctagtgcttgaggctcagaaattggaaaaacgggcaactaggtcaagcagtgttctcatagcctcacagatgagcatccaaagcaagggcctccttctagttgacttgtgccaagggacaggagaagcggagtctgccttctgggtccagaagggggttttgttaacatggagttgctcagcgcccttcataaaaattcttctggctgagggttctacgttggcatacggttggttccctcttcttttccgaggtggcgagtatctcttcctttgccaagatggcggctccagaatcctctggaggcggcccccgtagatcgtctccggacaagaggcttgctgaaagcctacttctttcctttcacatcagacaatgcacagggaaccgtttacccttgagaaccaaggaaggacggcttaggctacccgcgatcgcgaacctttgccaagatggtggccgcggggacgggctggcgacactgtaccctaccaagatggcggcgggcggcttccgggacgcgcttccccaatcgtcttcaagatgtcagagcagggggagccgccgtcagtctgagcgcggcgggaggtgagagagtggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgagggggaagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccgccgcgggagcctacaaacttttattagcctcggggagtgggggtggggggctggcaagggccgggcgacggtgacgaaagggcagcgcgcgggtgacagcgctggcctcttcctctccctccgcaggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtgagcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattcggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaaaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacaacattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatattgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgttcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgaagtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttaagactgacaggtgtatatgaatacagagagtatacataaagaagatgtattttcaattgacagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattataatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacatggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcaatgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggcagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagtaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttccgttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagtcaaataattaaggatttgttaaatatttgtcttaatatcaagcttttgcatatcggggccctcttttataagctttataagcaatcttttgttttctctgcttgctcaaagtagctatgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtagtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctatttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtctgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatatagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatcatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaaggatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttcttcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtgtgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccatttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctatttgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtctttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaatatcttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcatatacacagccctactcatgcatgtggccctctagatttccaggagtatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaaggagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccagagcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcaattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgtttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataagcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattgataaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagagtattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacaccaggatcctgtttgtaaaggcatctgccagtggtttctgtgacacaattctgtttctagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatatttatgggaaaattttaagttgtgcccttgtttcatgtgtgtttctatttaaagataccatacttaatatatattgttgattcattaacattgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacgagctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggccgaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacgtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatattaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctcactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactaattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaactaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtatgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatactgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtacaataaaaatacaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcctactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacaggctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagatatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacataggtaaacatgtggccatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacgattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctcgtgatagtgtgggagatcgcaaaacatctgatggtttaaatatggcagtttcccctgtgctttctctctctcctgccaccatgtaagactttccttgcttcctctttgccttctgccatgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaaagtttggaacgtcctagagacttgttttgaatacttttgaccaaaatgctgatagtgacgtggacaatgaagtccaggctgaaatggtcccagagatgaggaacttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttcctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagataaagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctctctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcgcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaattctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgattaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactacaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacttgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacaacaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctattctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcatggcacaccatagagggcatagggccacaggaacaagaggaaggtcacctaattctgtcttggaagtcaaggaagaagtaacattgaattttaaatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatctacgtttgaccaggctatttaaacttaactgcagagtgtcagcatgttaaacattgatttacataaaatgatagctgcccactttcttgtaaatgttataaaaactgtagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctaggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttgacagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtacatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttgtttaaatacccacagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggactatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccgccaagccaagaattttggctattttactatttagttcatgtttacttaagcagacagaggtgacaaaactggctttttttttttttttttacattaaaagctattaaaaagcacctagggggctgggtgcgatggctcacgcctgtaatcccagcactttgggaagcccaggtgggtggatcagttgaggtcaggagttcgagaccagcctggccagcatagcaaaaccccatctctactaaaattacaaaaattagccgggcatggtggtatgaatctgtattcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaaacacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttctttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacggggttttgccatattggccaggctggtcttgaactcctgacctcaagtgatccacccactttggcctcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatgggaagacatggaaaaagaaagctaactacagtgattttgtccactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagccaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaacaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactaaaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgcccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcttttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttatggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaatactgtttttaaaaagtatgattaatccattaaattagaataatgcacccttcatatattatggtactacagtgattcatgaaataattctatataattctacatacaatcaaagaaatataaaatgtgttttgtacggaagtgcttatttttcatctggggaattccagtgagattggtatattctaggccagataattttttcaaaatagaggacaacaaacatgagatgttcccactgaccaatttggaagcctgatcattaccatatcttctcttgcaggtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcattatgtgactccaacatgcttttgtagaacttgtacagttccgattgtccaatctgatttttgtttactgaaagtagagttacccctgcttcaggaaccttaagataatatggtgggcatttaaatgtcagtgtggcaatgttcgcctgctaatatggcatagattcaaaataagcttaaccctggtgccaaagacctgaagattatcccatccatgcctcaaatggttgtgtgccaattactgcaaagggtactaagggaaggagaaattcactcctgaggctgcttcaaatgtatgtctttatcacaaaagatgacattttatgtaagctaatgttatctagtcaaaattcttagcttattttaaaatcaactcttcaagaaaaggaataaacatttaatataaatatcatagcagtattgcacatagaatagaaaggtcgggcagggtagtggaagtcagctattctatacaatccattcggtattttccaaaacatttgatgttcaggccatatccaggaactggatgacctaacaaacttctctgagtacctttttttccacaagagatctccatcactaagaaaaaaagcattgtgatttaaaagccaaatttgccttatccatcatcatgtgcaccaagtatttgctacctgcctactatataatattgaagatacaatgtgaataagaaaaatactattgctaccctcaatcagagtatgtgattggaaaagtgtataacaaacctttcccagtgtcttcaggtataatgcagagataccagatacggcatcaatgtgtatacacattatggctgtaccattcactttaagtagtaaccttacatttctgtagaacaccttcacatacatttttaacaagcctcactgaatgaattaatgacatgaaaataatgaggcagattattctcgtttccattttataaggaagtaaactctgtaagaaagtaaacaggctcagaatttaagcactgattcatagcccctagctcccatgttattgaaatttgaatggaaagcctctaatgaggccattcatctatcagatgtcaaagagcatgtctctggcctatgagcctctcagggaactggttatgtttttctgttttaaattaaactaatgctttactgagcacttactatgtgccacgcacaatgataattcaatatattatttcatttaatcatagtacccctctaaagtactactgtaaagcagtgctattatcctcattgcatttatatcaggaaactgtggcttaaagaattgagtaacttgcctacagtcacaaagctagctccagaatccatagttttaaaaaccactattgagaaattactaatatgagctaactagggcgaatgaacccatattgatcattatgtgtctggccttttgacatgtcctcatttaatctaatcccttttgctaccgtatcaattttgacttagaaatttaacaatgatacattagtccccgcttatctacggaggatatgttccaagactcccaatggatgcctgaaacatagatagtactgaactgcatgttttttcctatattacatacctatgataaagttaatttacaaattagatgcagcaagagattaacaataactcaattacaacaatatactgtaataaaagttatgtgaatgtgagctctcaaaaaatcgtactatactgagggtaactgagaccacggaaagtgaaaccgcagataaggcgggcactattgtatttccttctcttaaaaacgtgtcctgtaccctggggtggttgatggtggaaaatactagttgcccacagattacagaatgccctttggtttgtctaatatacaacagggagcctgtctcactaatgcccacagaaaaatcaaacatttcttcaagtgatatggagcatatagggtacagtcaaaccaaggaagaaagttgtttataaatgagaactatagtgcaagttaaaatttgctcctagttttgcaggtaaagagccagactttgggtgtagaaaaaaagttgaaaatactgaggcttttacataaggtgattttttttttttttttttttttttagaatttcaactaatctcttttaacttaagtcgttcttaacagtattggtaacttcatagcactttctttctggtgaaataaccccatcctccctcttatttaggcttcctgtttcctagttaaaatggggcagtactttgttagggaagtatttttacttcacttggttacaaacatgtaagtctcagaacaaaagagtttgtgcagaccatatcagacactcaaaagactttcttcactctacccacttgagtaagagacaatttatattctgttcaccttatgtaccctcaccaaaaatattcaatagggtaataatgtgtata

(The sequence listing continues in the following parts.)

The invention claimed is:

1. A compound having the formula (XXVI):

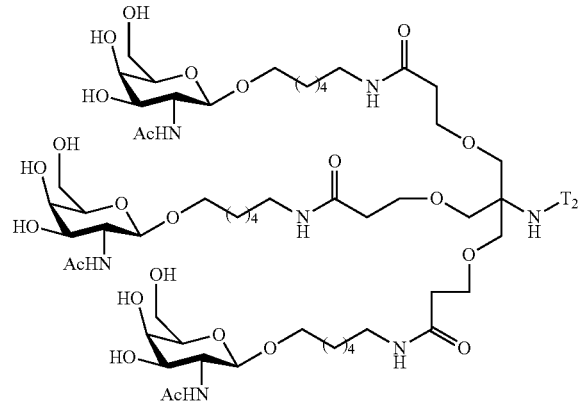

(XXVI)

wherein:

T$_2$ is a group comprising a nucleoside, a nucleotide, a monomeric subunit, a reactive ester, a linker, a cleavable moiety or an oligomeric compound.

2. The compound of claim 1, wherein the linker comprises an amine, an amide, an ester, an ether, a pyrrolidine, PEG, a polyamide, or a disulfide bond.

3. The compound of claim 1, wherein the linker does not comprise a pyrrolidine.

4. The compound of claim 1, wherein the linker has the formula:

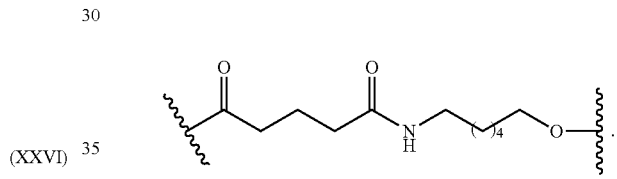

5. The compound of claim 1, wherein T$_2$ has the formula:

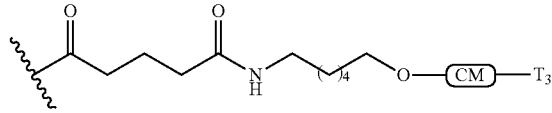

wherein:
CM is a cleavable moiety and T$_3$ is a nucleoside, a nucleotide, a monomeric subunit, or an oligomeric compound.

6. The compound of claim 1, wherein T$_2$ has the formula:

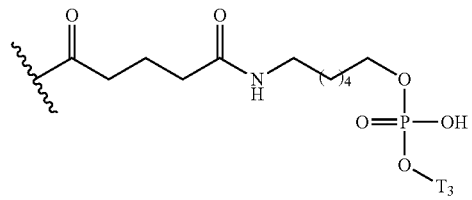

wherein:
T$_3$ is a nucleoside, a nucleotide, a monomeric subunit, or an oligomeric compound.

* * * * *